(12) United States Patent
Brown et al.

(10) Patent No.: US 9,708,605 B2
(45) Date of Patent: Jul. 18, 2017

(54) METHODS AND COMPOSITIONS FOR THE SPECIFIC INHIBITION OF MCL1 BY DOUBLE-STRANDED RNA

(71) Applicant: Dicerna Pharmaceuticals, Inc., Watertown, MA (US)

(72) Inventors: Bob D. Brown, Millington, NJ (US); Henryk T. Dudek, Wellesley, MA (US)

(73) Assignee: DICERNA PHARMACEUTICALS, INC., Cambridge, MA (US)

( * ) Notice: Subject to any disclaimer, the term of this patent is extended or adjusted under 35 U.S.C. 154(b) by 0 days.

(21) Appl. No.: 14/385,325

(22) PCT Filed: Mar. 14, 2013

(86) PCT No.: PCT/US2013/031753
§ 371 (c)(1),
(2) Date: Sep. 15, 2014

(87) PCT Pub. No.: WO2013/138668
PCT Pub. Date: Sep. 19, 2013

(65) Prior Publication Data
US 2015/0065555 A1     Mar. 5, 2015

Related U.S. Application Data

(60) Provisional application No. 61/612,037, filed on Mar. 16, 2012.

(51) Int. Cl.
| | |
|---|---|
| *C07H 21/02* | (2006.01) |
| *C07H 21/04* | (2006.01) |
| *A61K 48/00* | (2006.01) |
| *C12N 15/113* | (2010.01) |

(52) U.S. Cl.
CPC ........ *C12N 15/113* (2013.01); *C12N 15/1135* (2013.01); *C12N 2310/11* (2013.01); *C12N 2310/14* (2013.01); *C12N 2310/321* (2013.01)

(58) Field of Classification Search
CPC ... A61K 48/00; C12N 15/113; C12N 2310/11
See application file for complete search history.

(56) References Cited

U.S. PATENT DOCUMENTS

| | | |
|---|---|---|
| 2007/0270368 A1 | 11/2007 | Freier |
| 2010/0004142 A1 | 1/2010 | Khvorova et al. |
| 2010/0087330 A1 | 4/2010 | Leyland-Jones et al. |

OTHER PUBLICATIONS

International Search Report from corresponding International Application Ser. No. PCT/US2013/031,753, May 28, 2013, 4 pages.

*Primary Examiner* — Amy Bowman
(74) *Attorney, Agent, or Firm* — MH2 Technology Law Group, LLP

(57) ABSTRACT

This invention relates to compounds, compositions, and methods useful for reducing MCL1 target RNA and protein levels via use of dsRNAs, e.g., Dicer substrate siRNA (DsiRNA) agents.

43 Claims, 47 Drawing Sheets

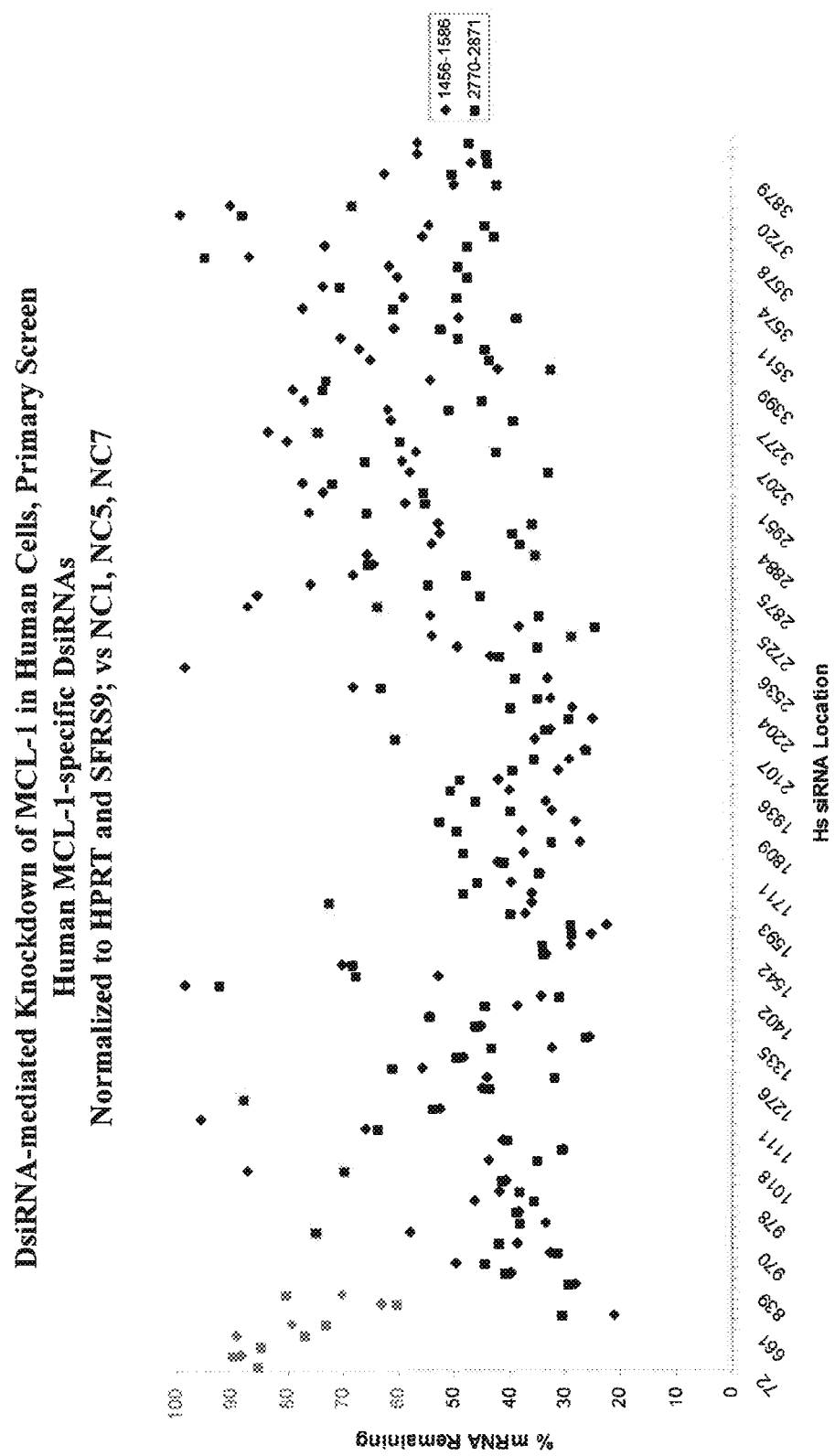

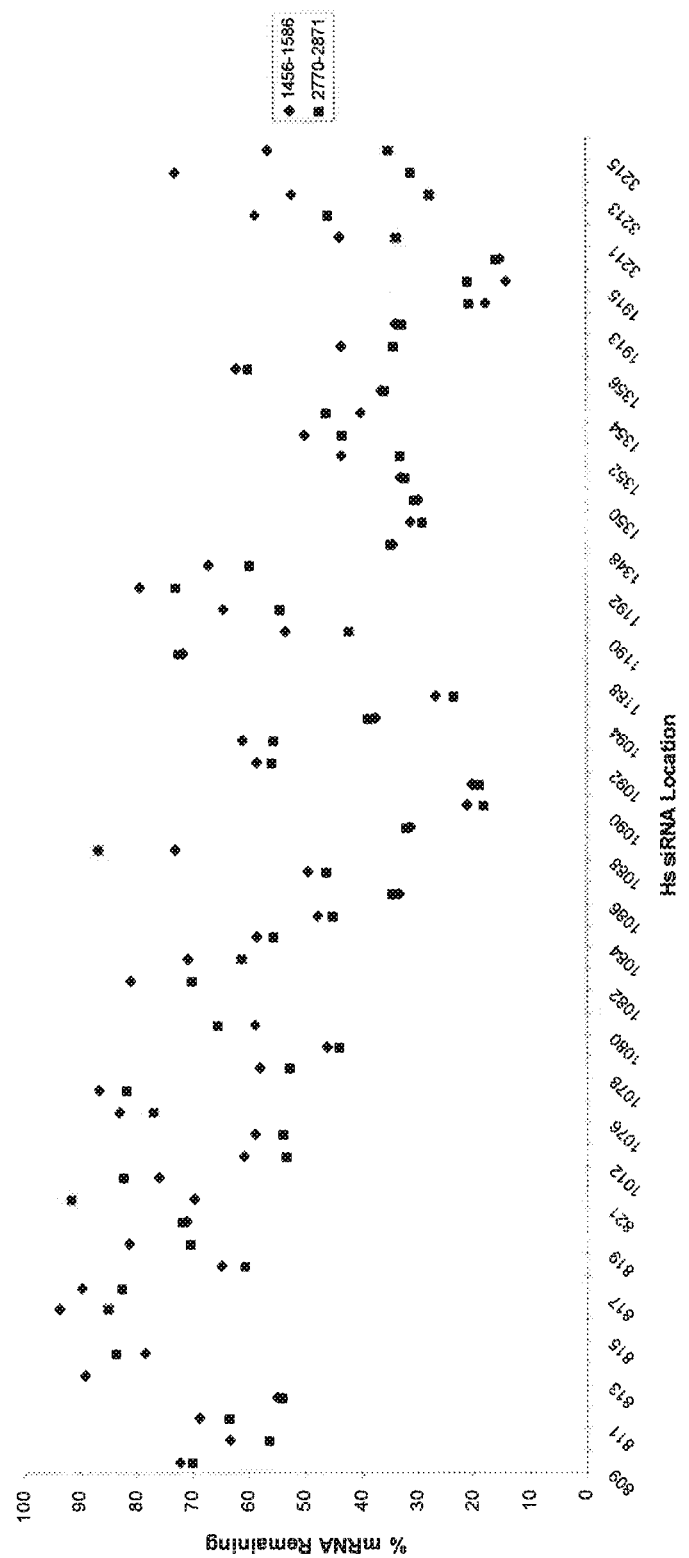

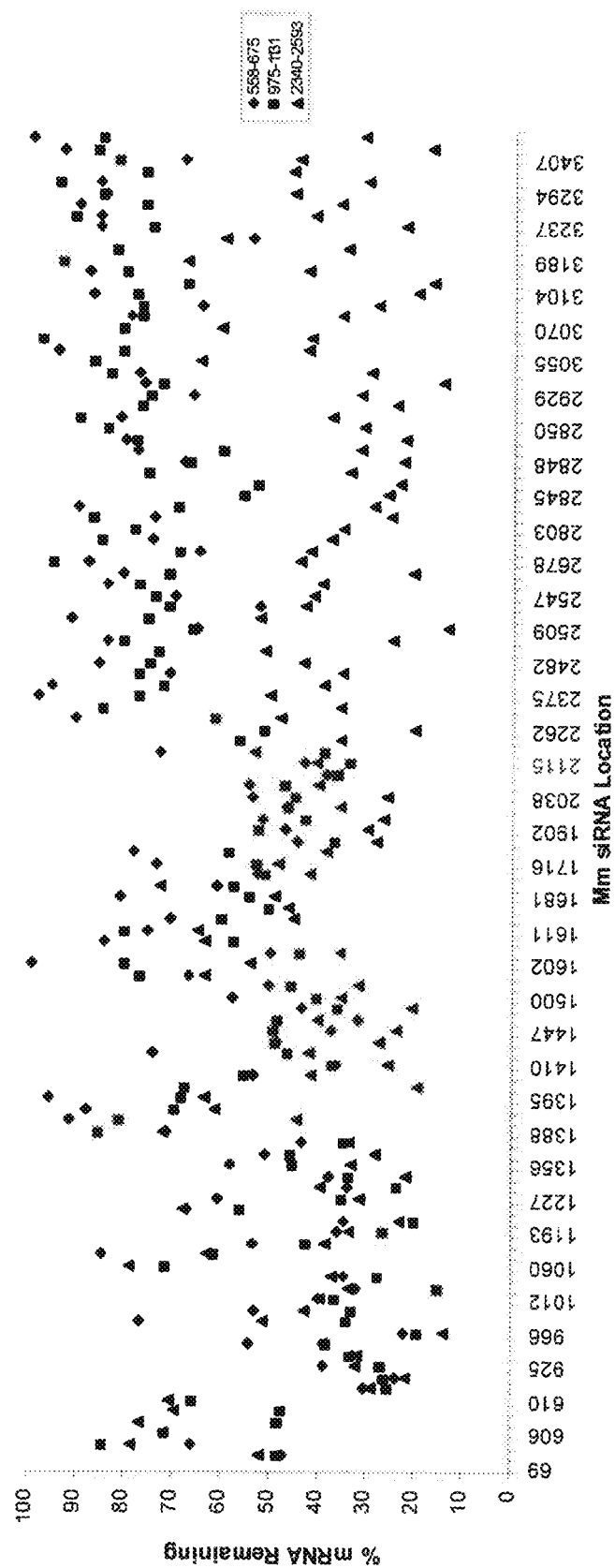

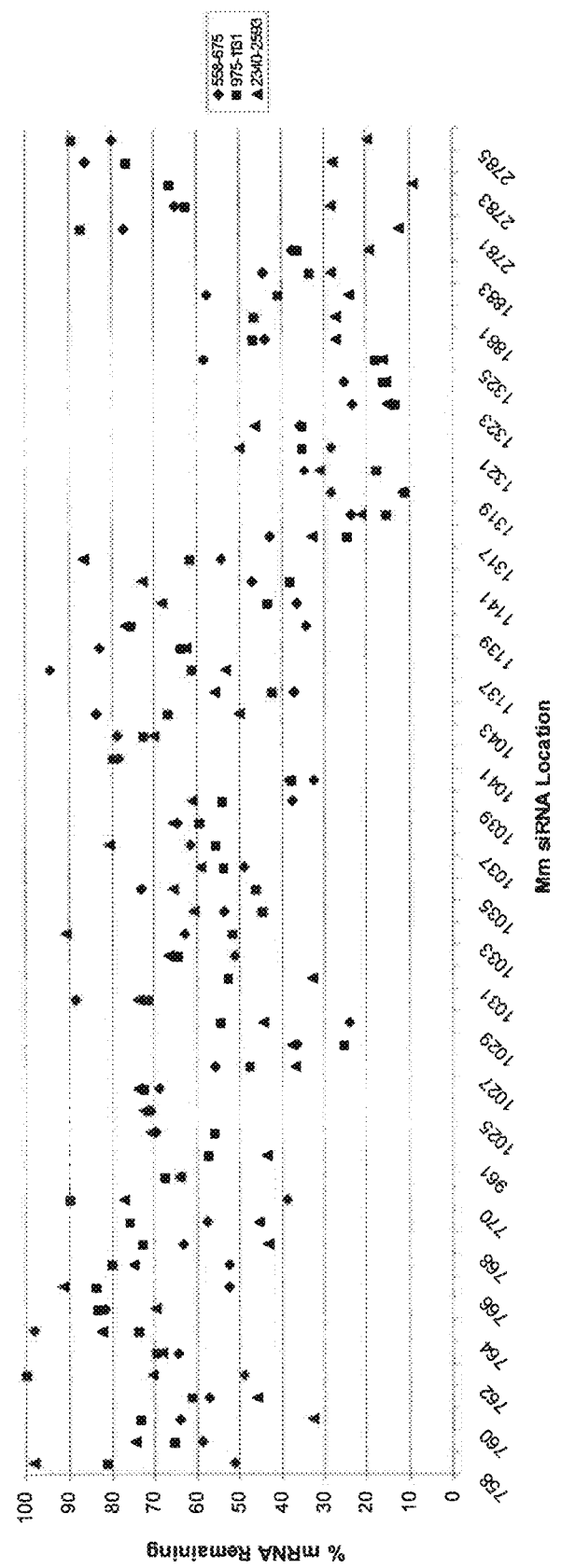

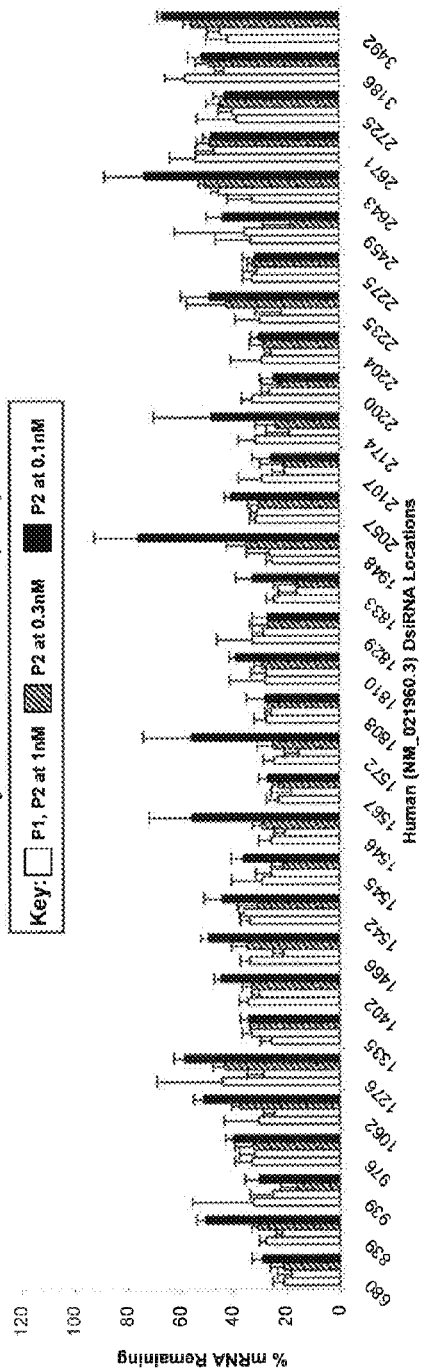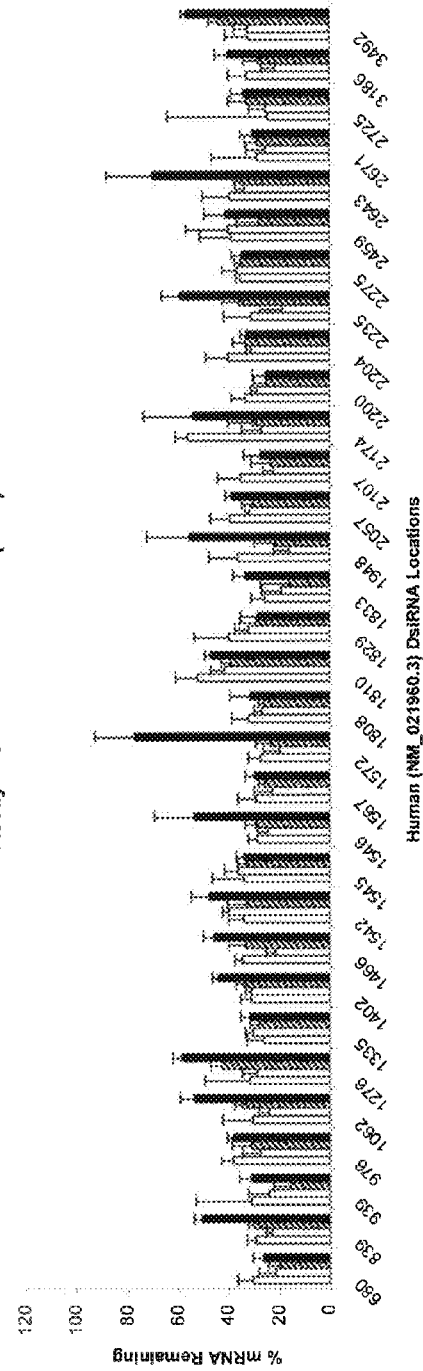

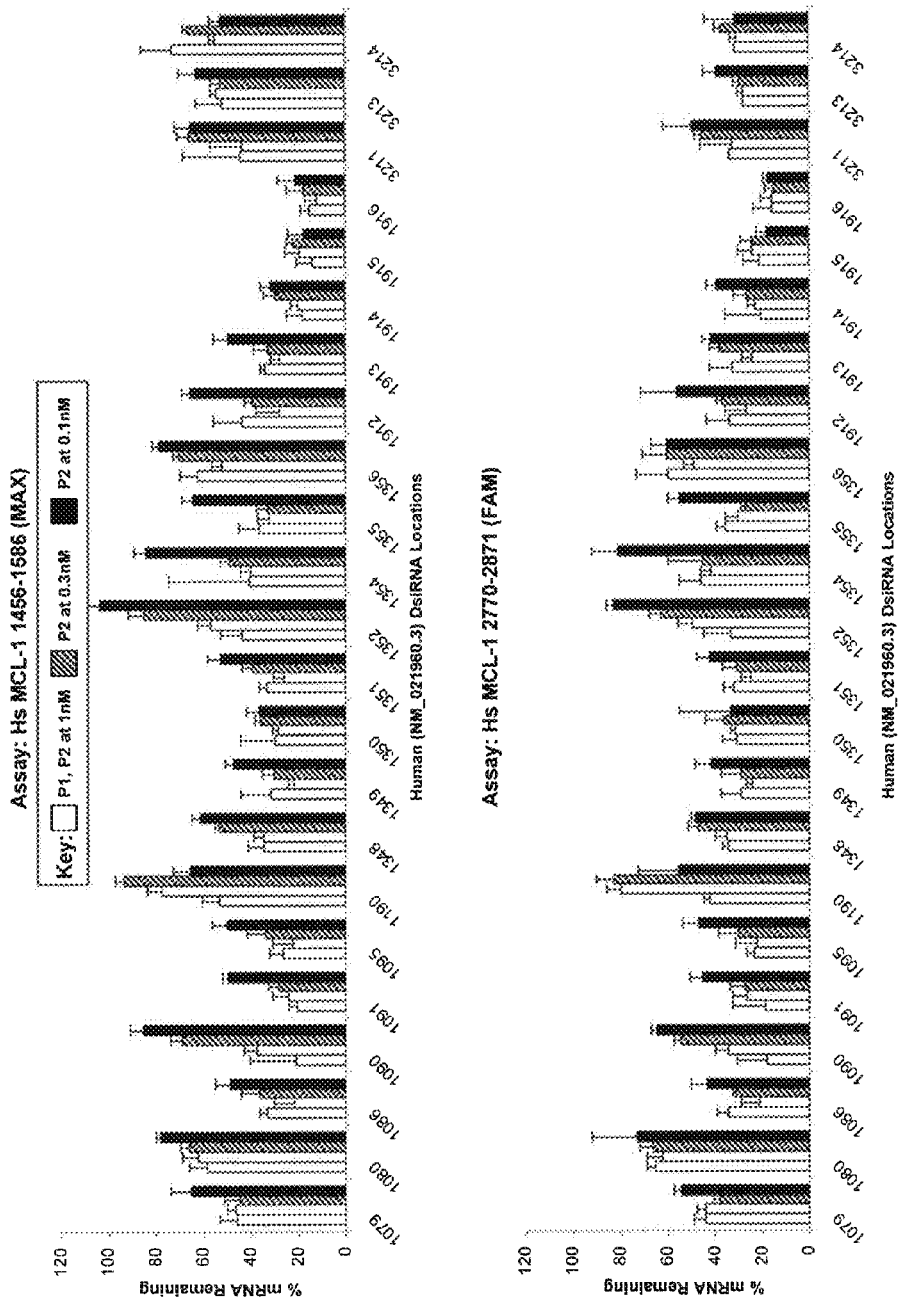

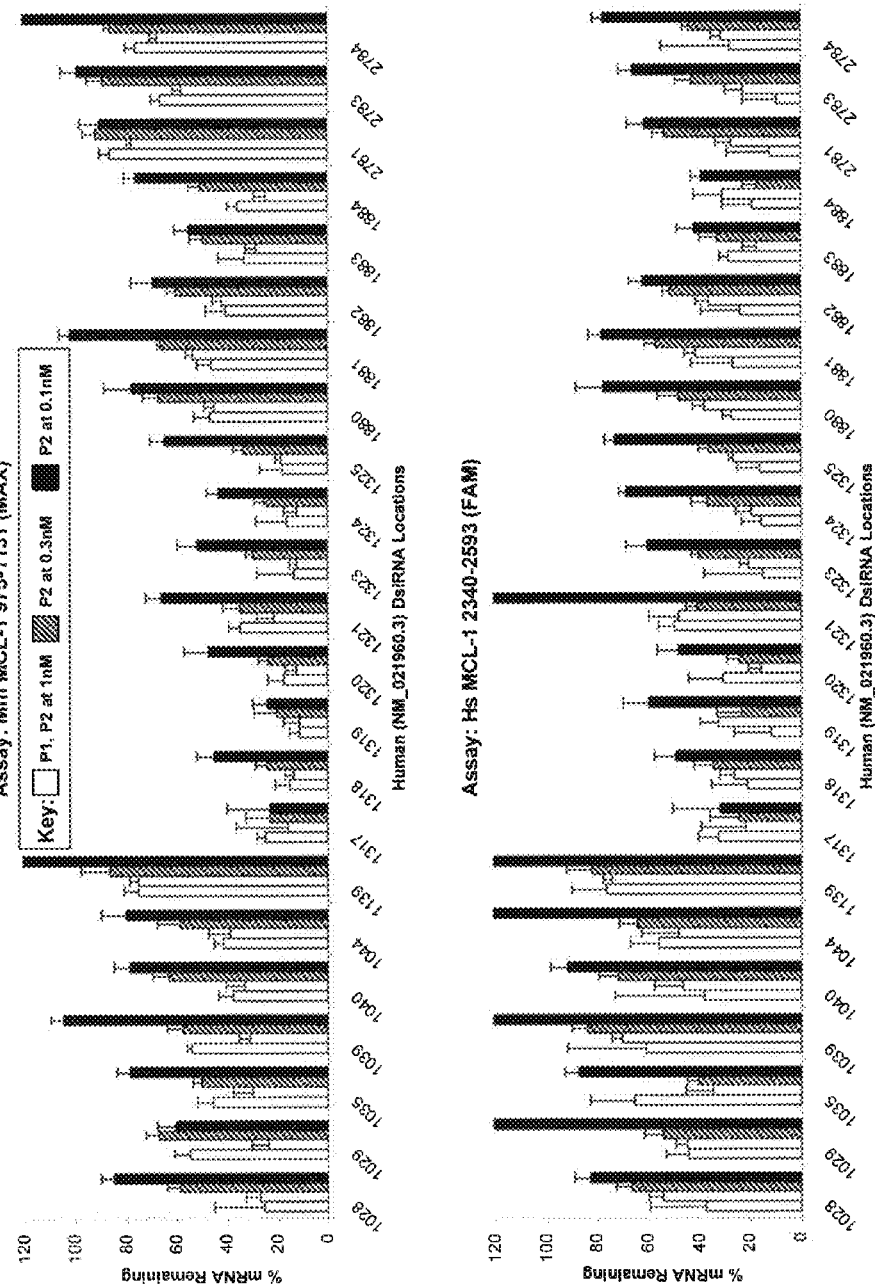

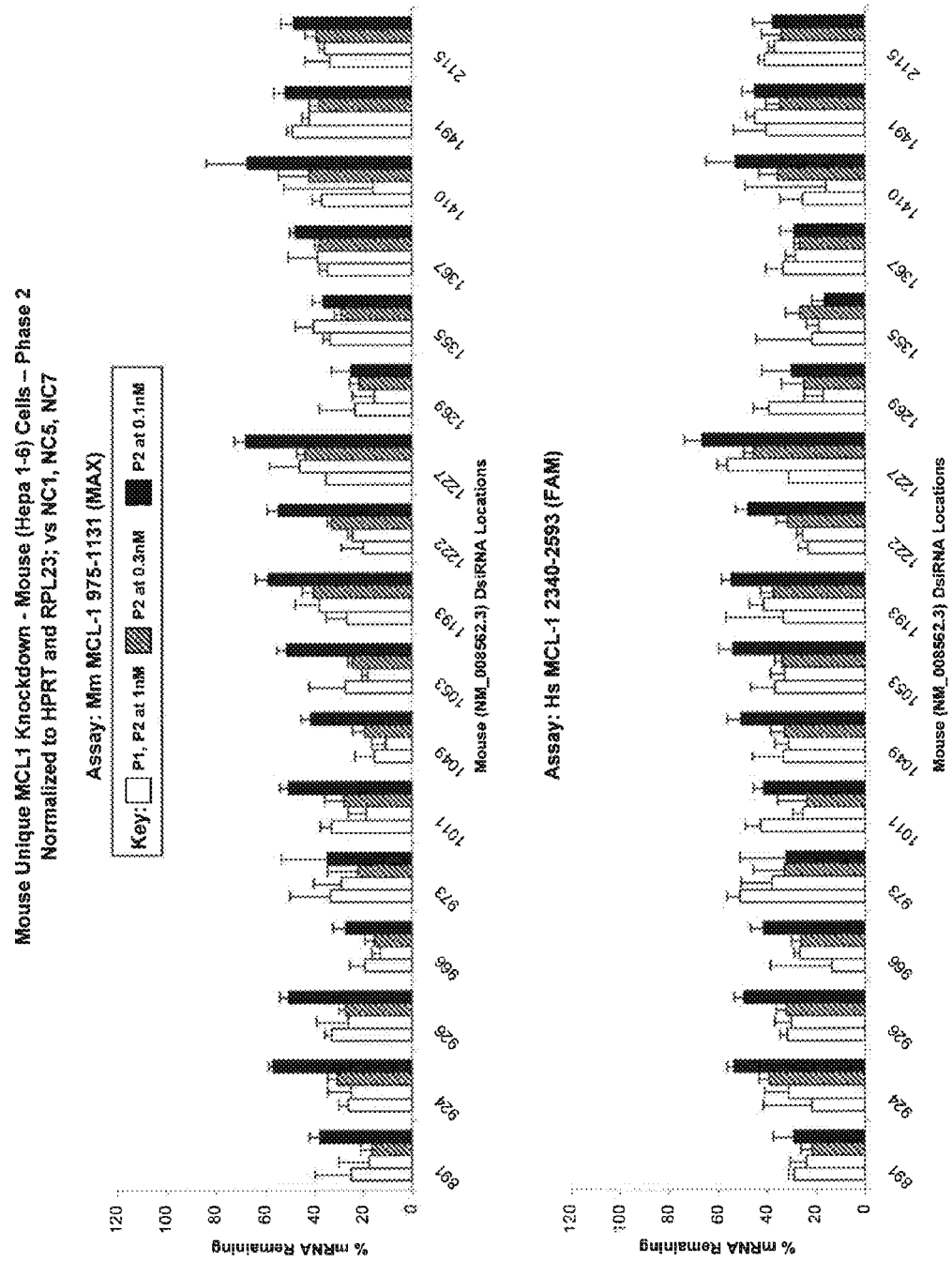

Human MCL1 Knockdown in Human (Huh7) Cells – Modified Guide Strand Normalized to HPRT and SFRS9; vs NC1, NC5, NC7

Human MCL1 Knockdown in Human (Huh7) Cells – Modified Guide Strand Normalized to HPRT and SFRS9; vs NC1, NC5, NC7

Figure 4-9
Mouse MCL1 Knockdown in Mouse (Hepa 1-6) Cells – Unmodified Guide Strand
Normalized to HPRT and Rpl23; vs NC1, NC5, NC7
| M0 | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 |
|---|---|---|---|---|---|---|---|---|---|---|---|---|---|---|---|---|---|---|---|---|---|---|---|---|---|---|---|
|  |  |  |  |  |  |  |  |  |  |  |  |  |  |  |  |  |  |  |  |  |  |  |  |  |  |  |  |  |
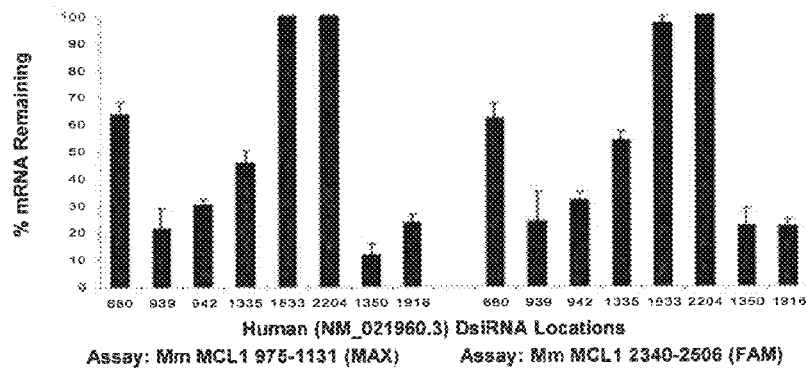
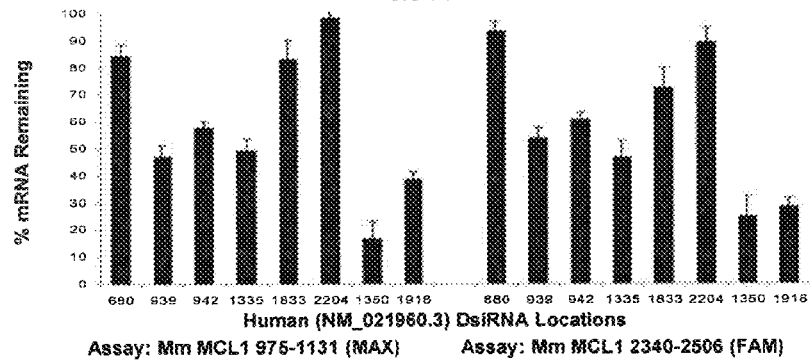
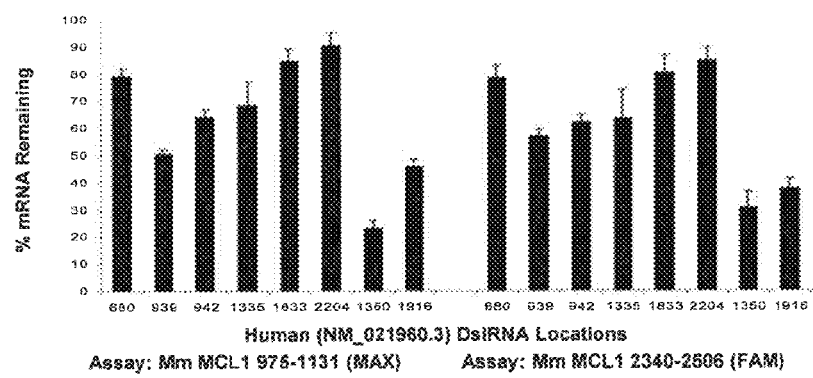

Figure 4-11
Mouse MCL1 Knockdown in Mouse (Hepa 1-6) Cells – Modified Guide Strand
Normalized to HPRT and Rpl23; vs NC1, NC5, NC7
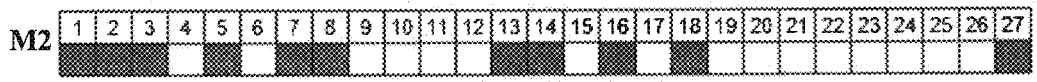
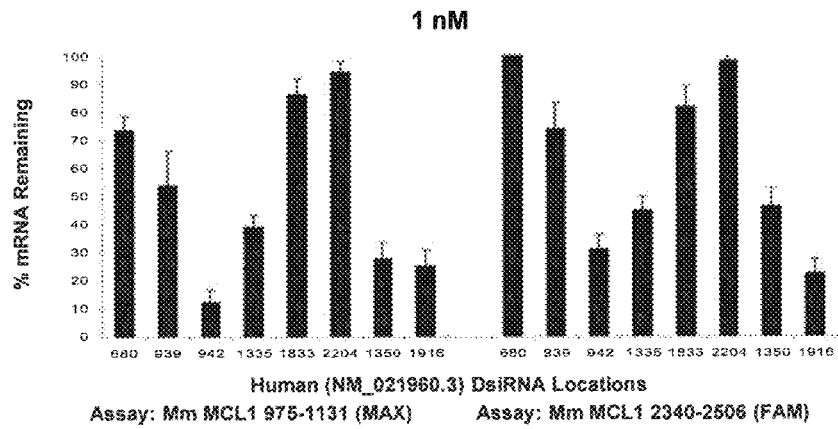
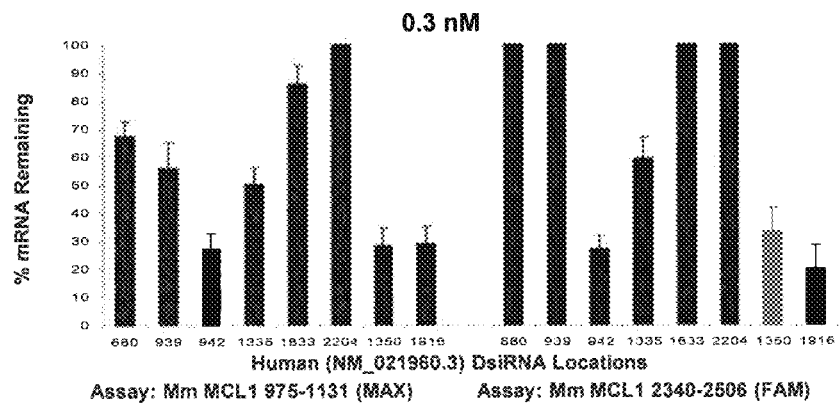
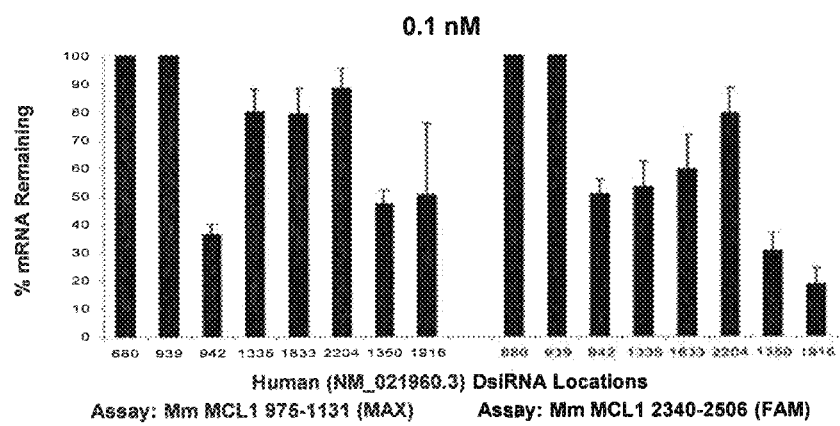

Figure 4-12
Mouse MCL1 Knockdown in Mouse (Hepa 1-6) Cells – Modified Guide Strand Normalized to HPRT and Rpl23; vs NC1, NC5, NC7
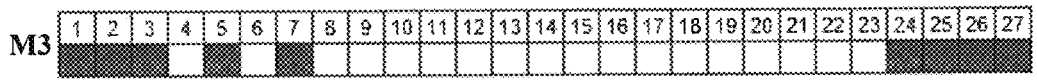
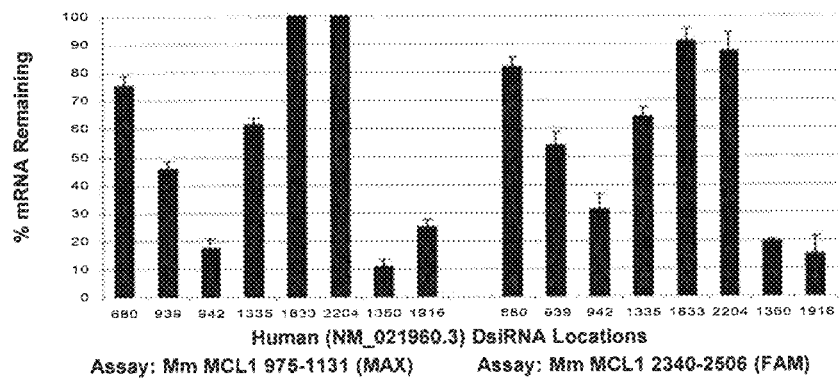
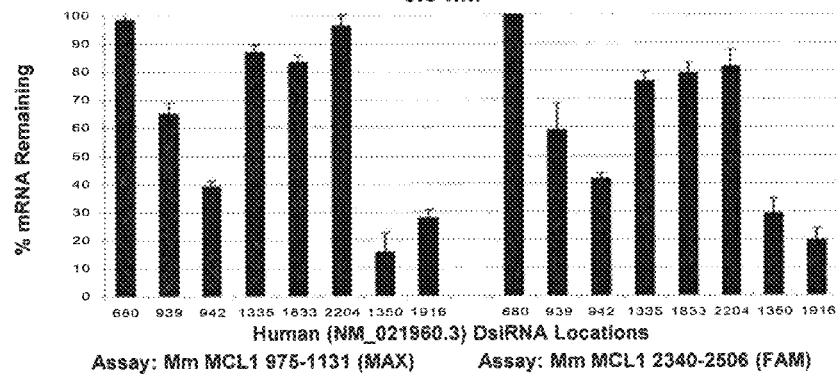
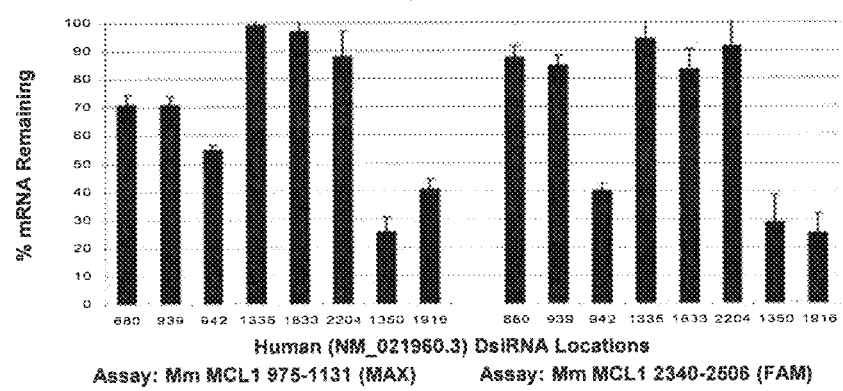

Mouse MCL1 Knockdown in Mouse (Hepa 1-6) Cells – Modified Guide Strand Normalized to HPRT and Rpl23; vs NC1, NC5, NC7

Mouse MCL1 Knockdown in Mouse (Hepa 1-6) Cells – Modified Guide Strand Normalized to HPRT and Rpl23; vs NC1, NC5, NC7

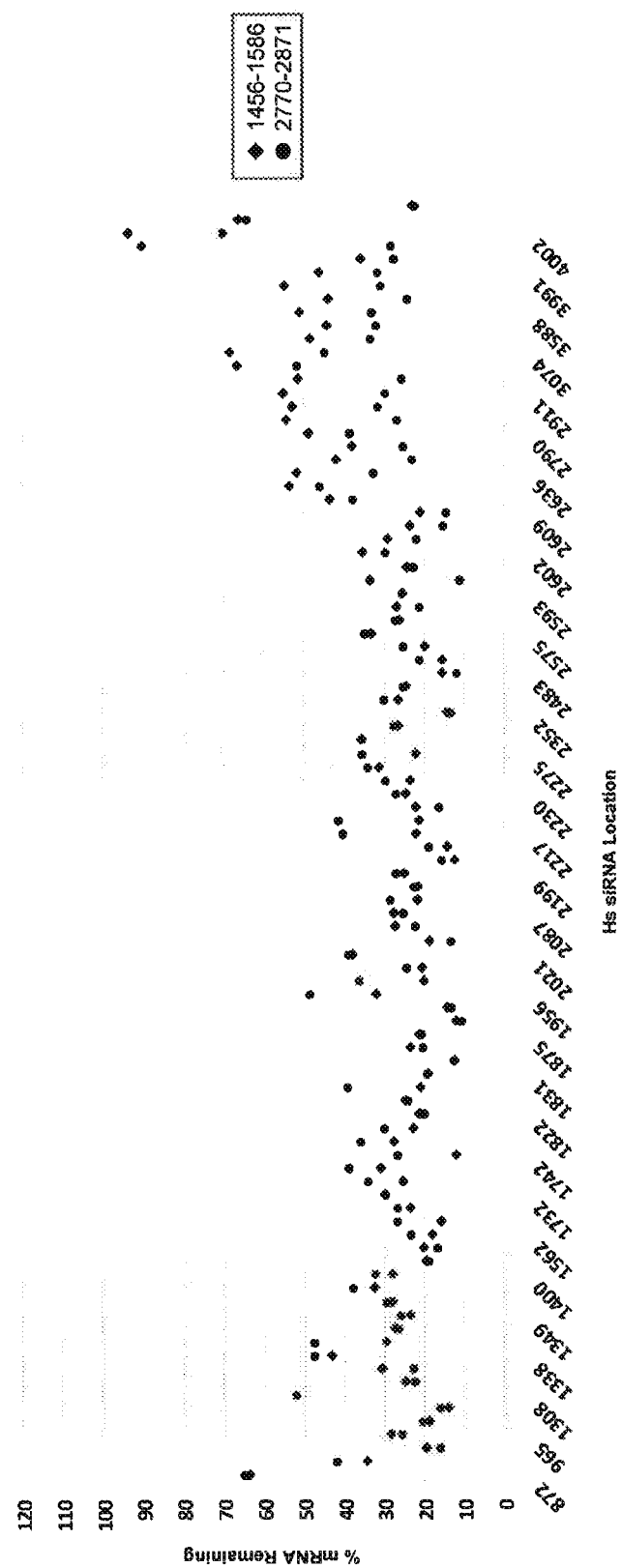

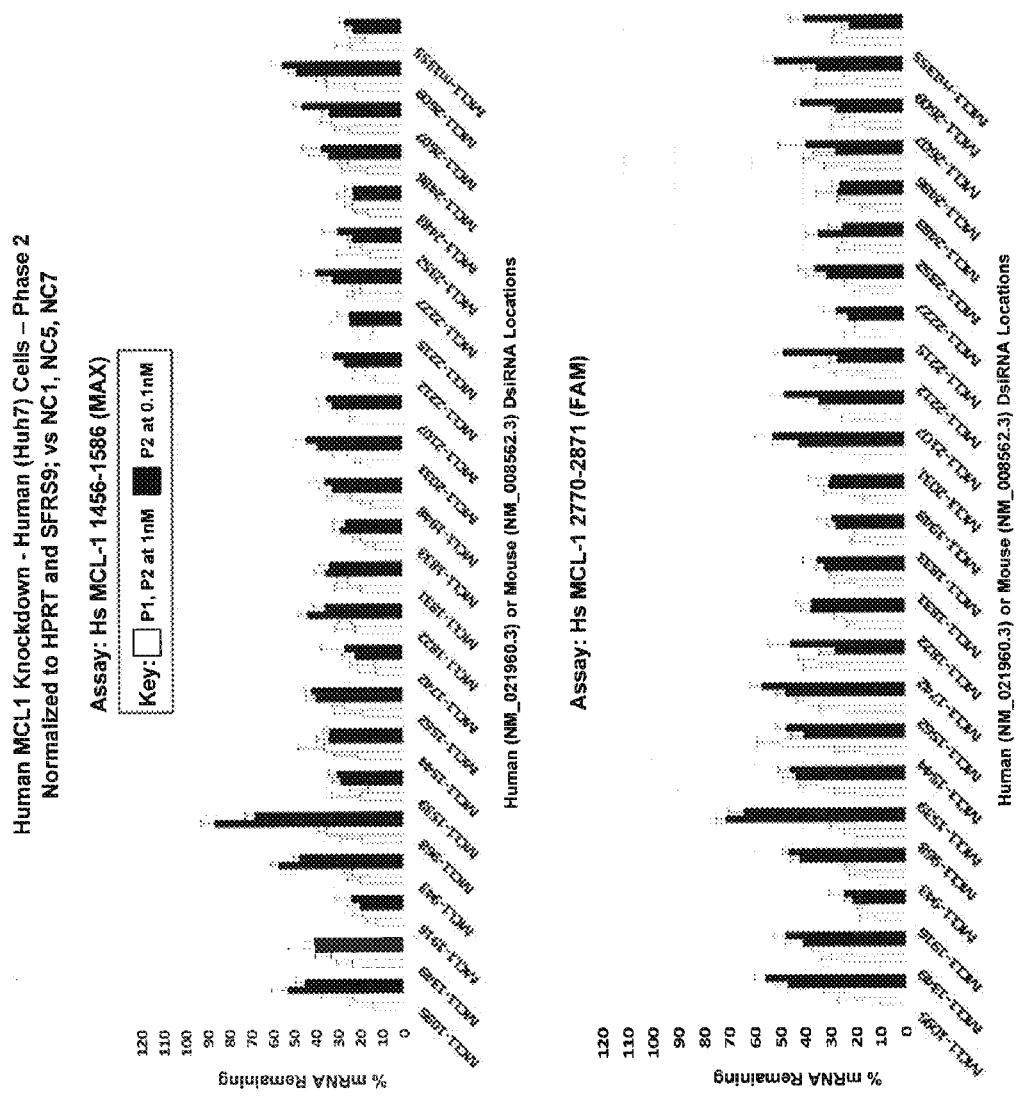

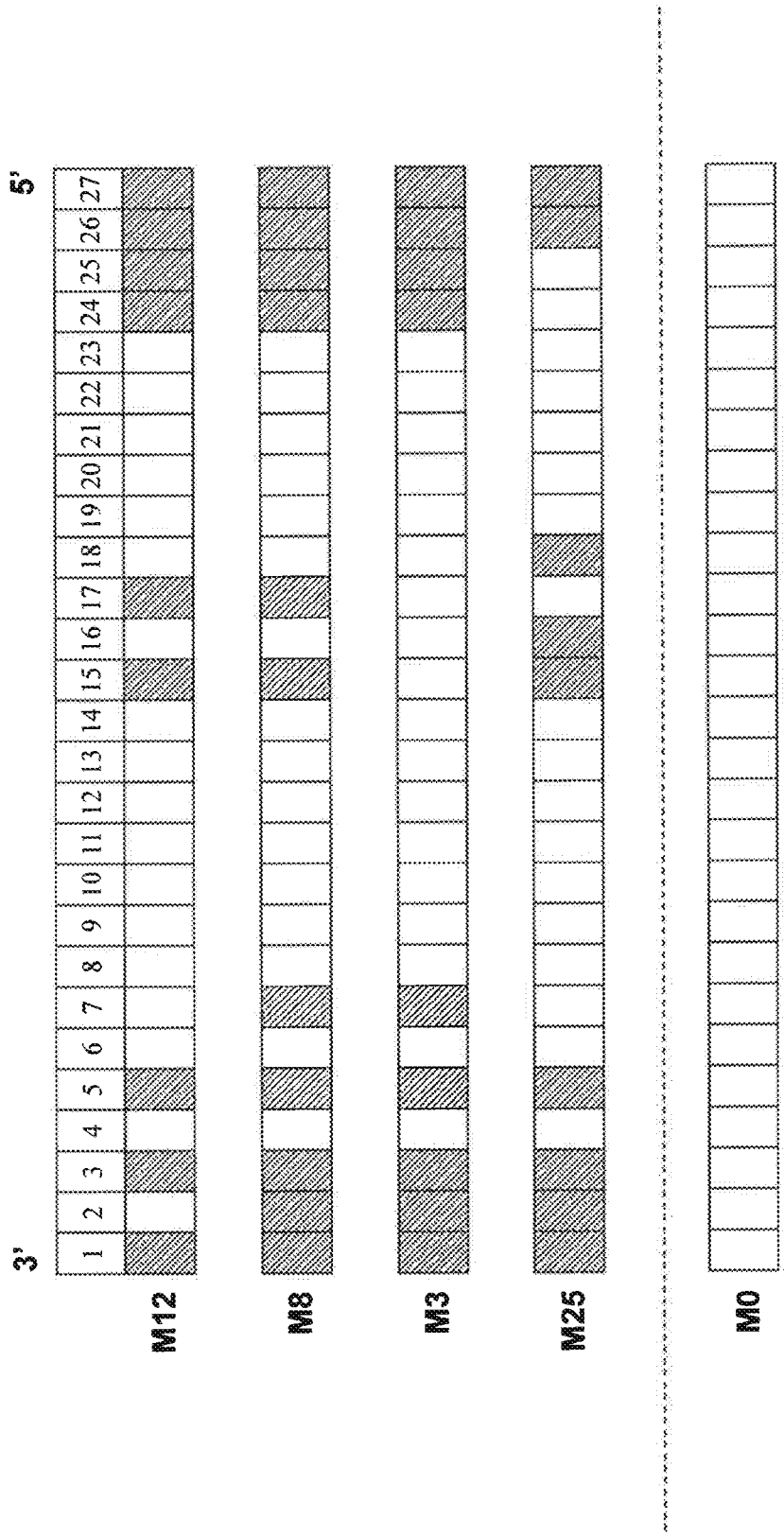

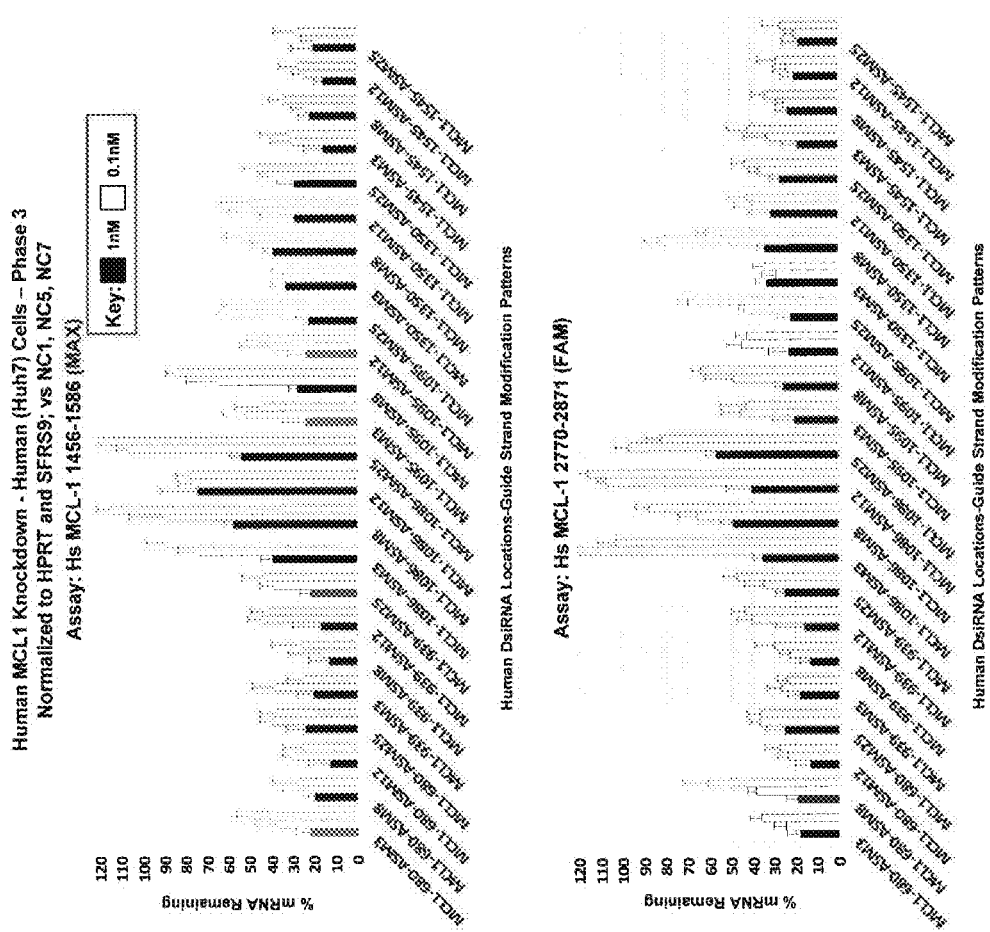

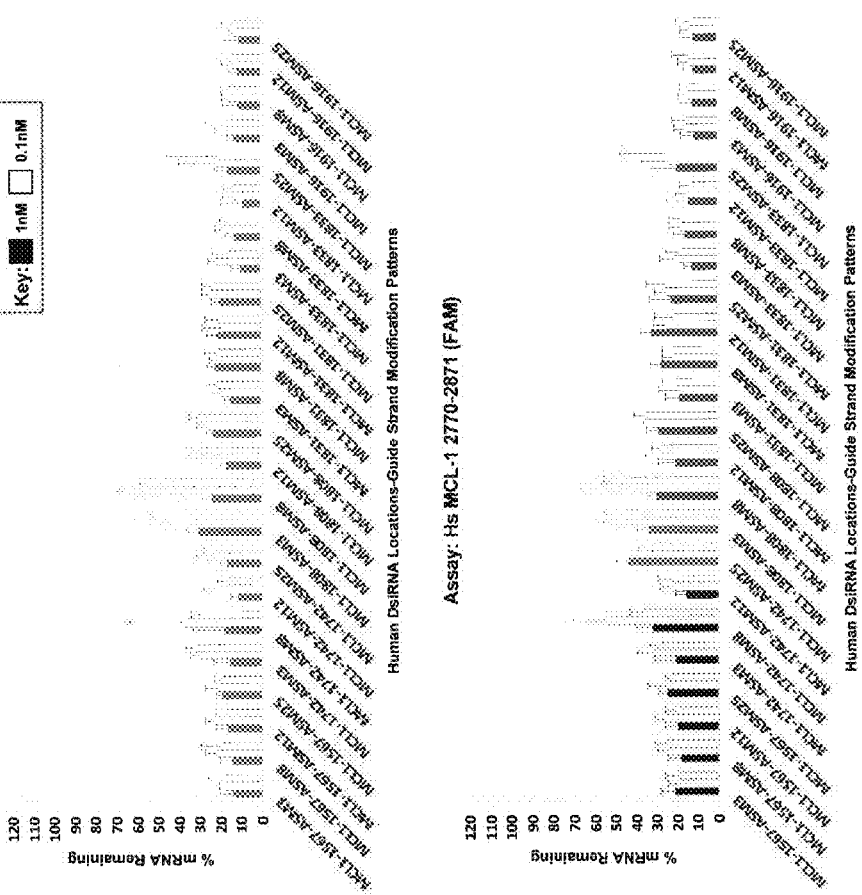

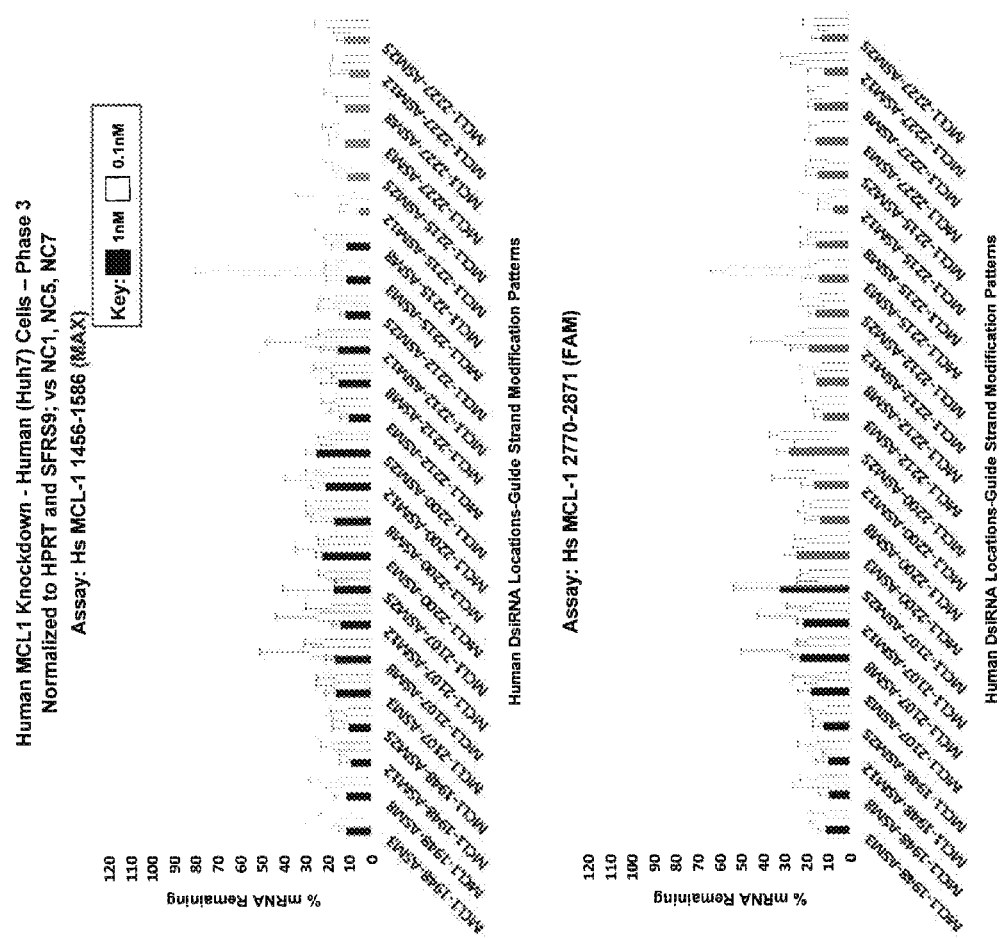

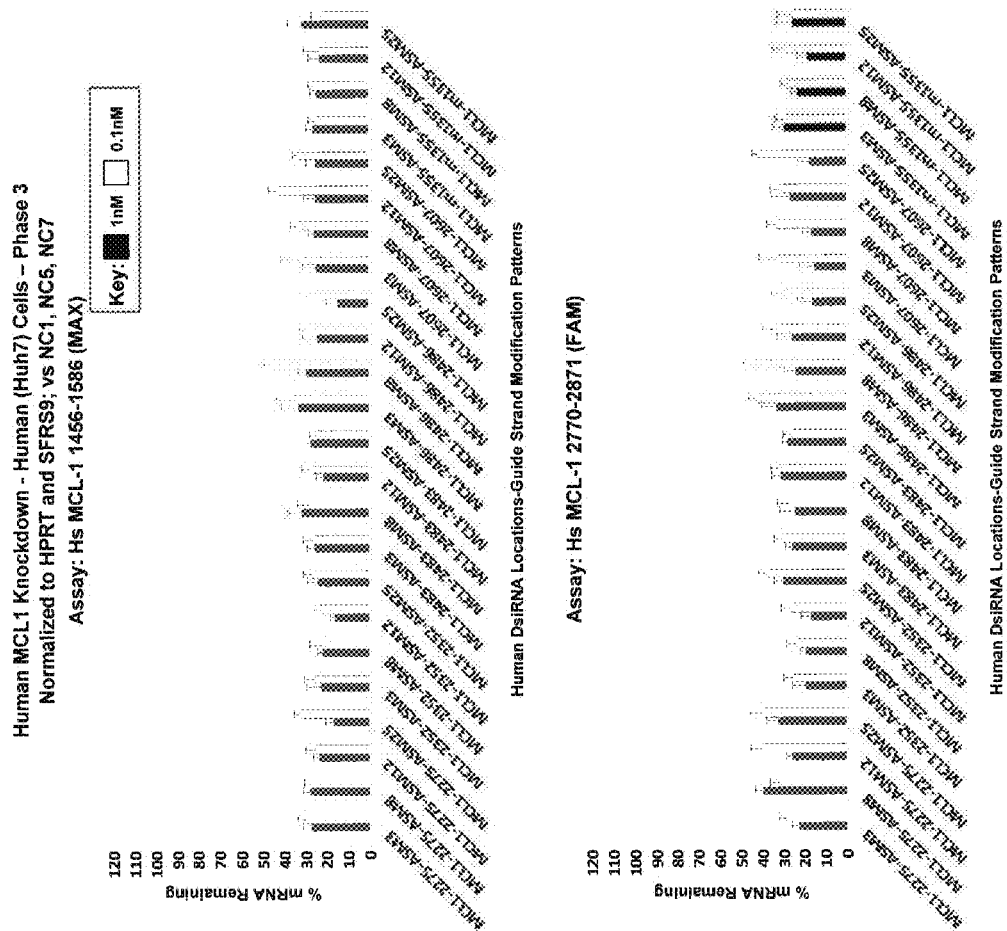

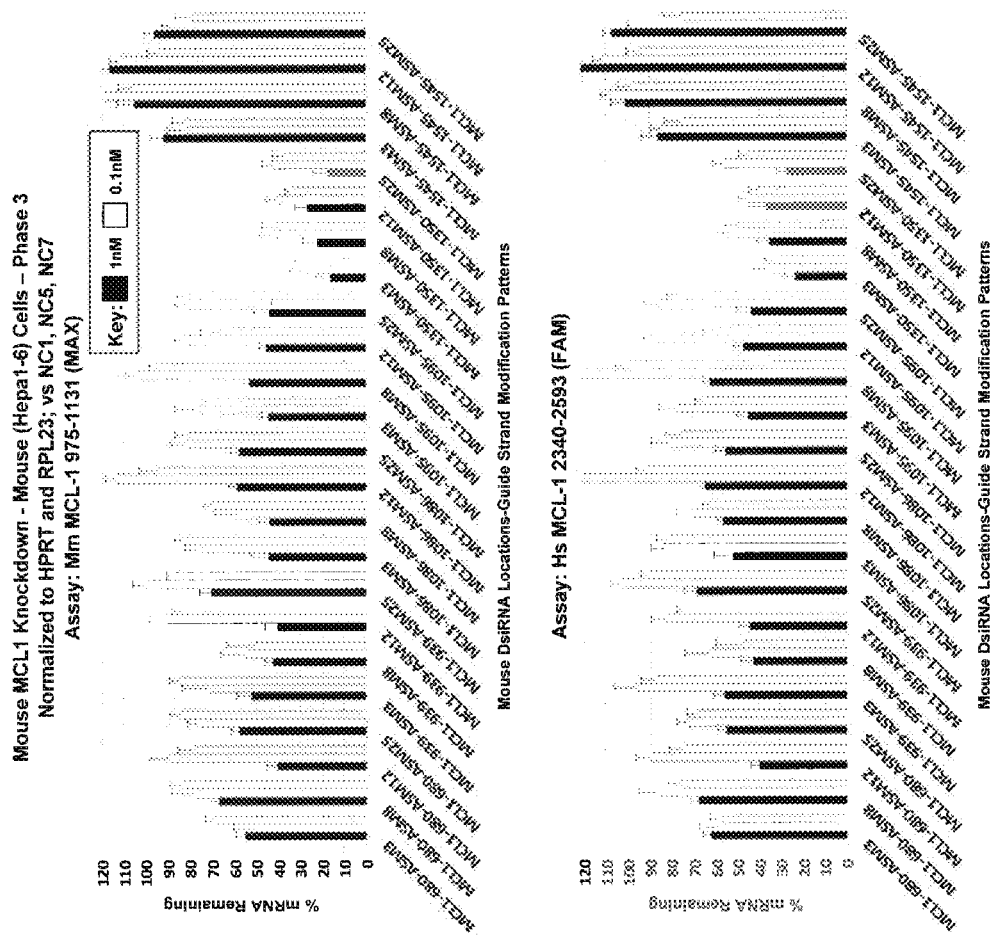

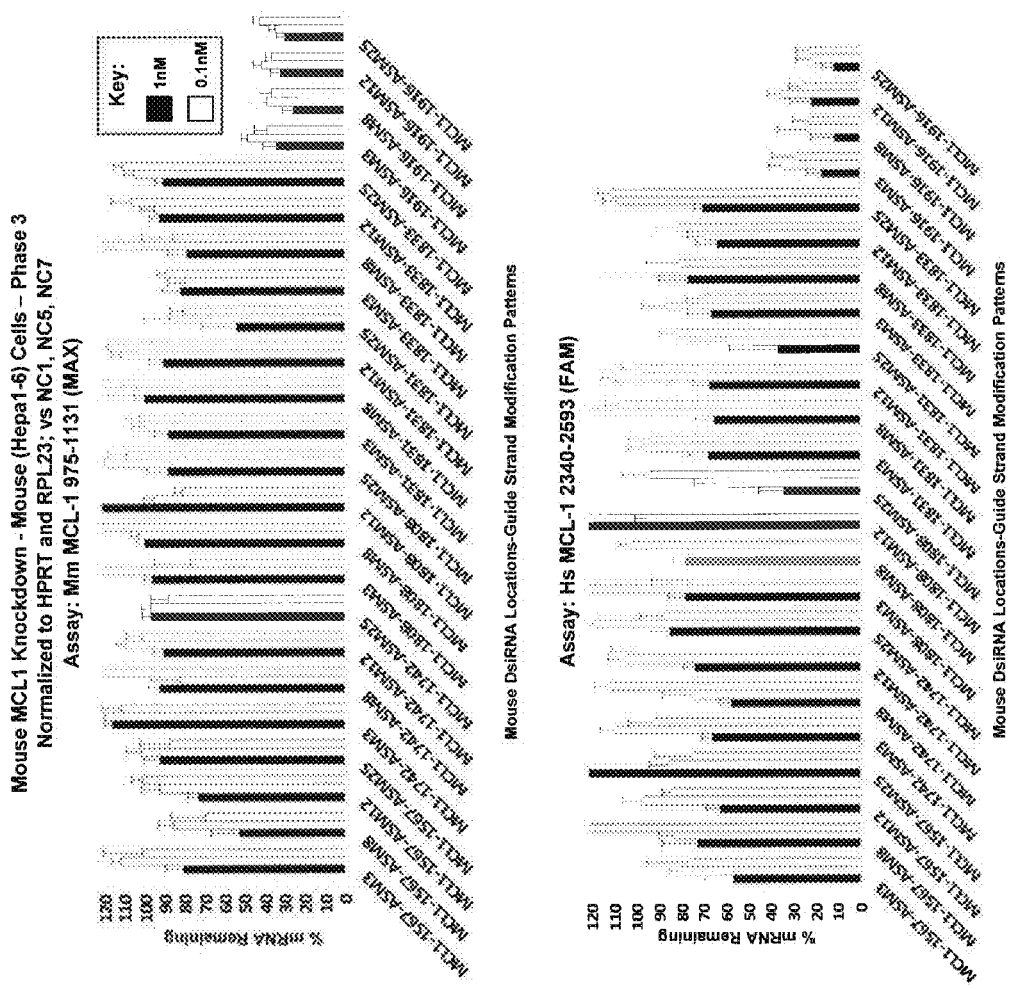

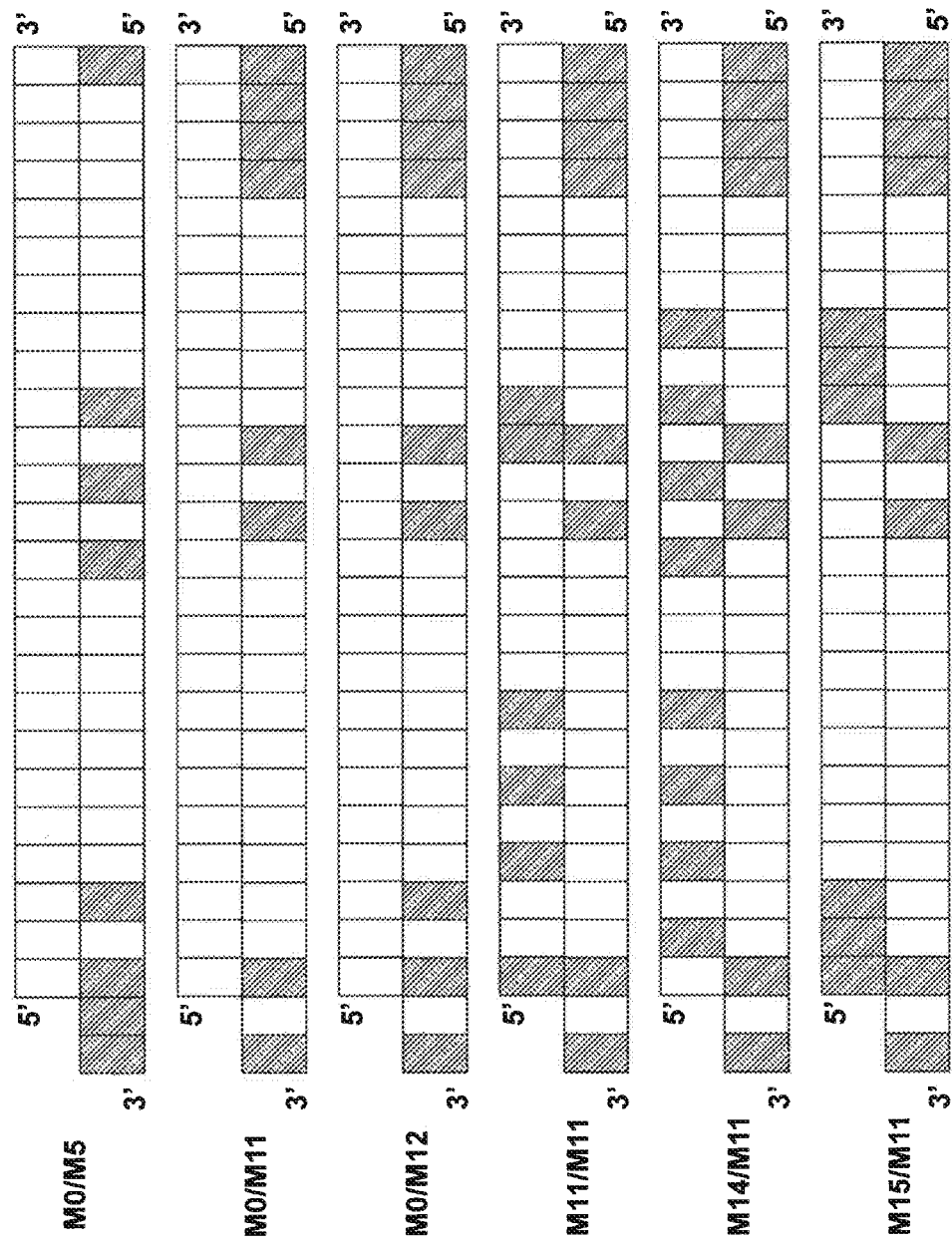

Additional Exemplary Modified 25/27mer Duplexes

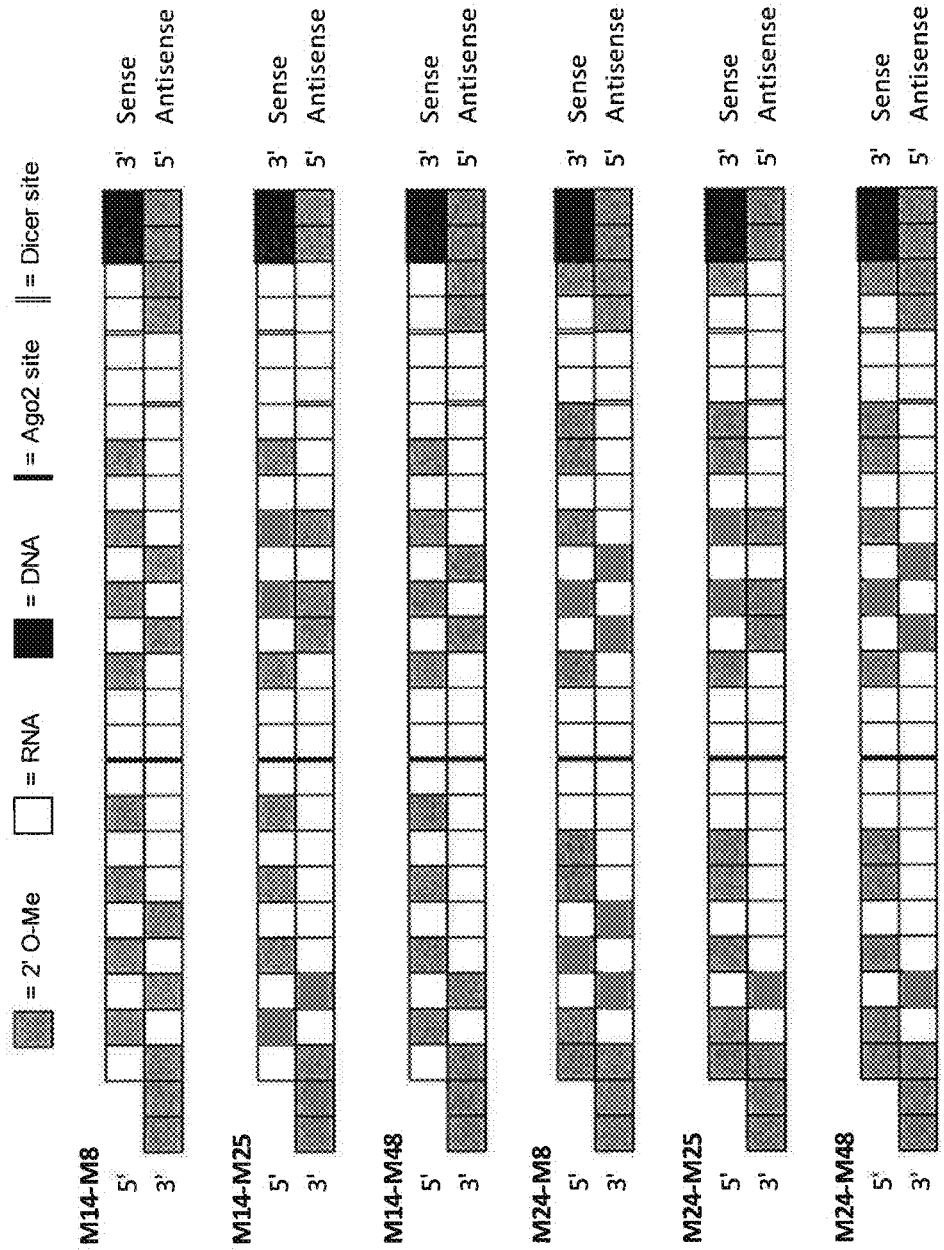

Additional Exemplary Strand Modification Patterns

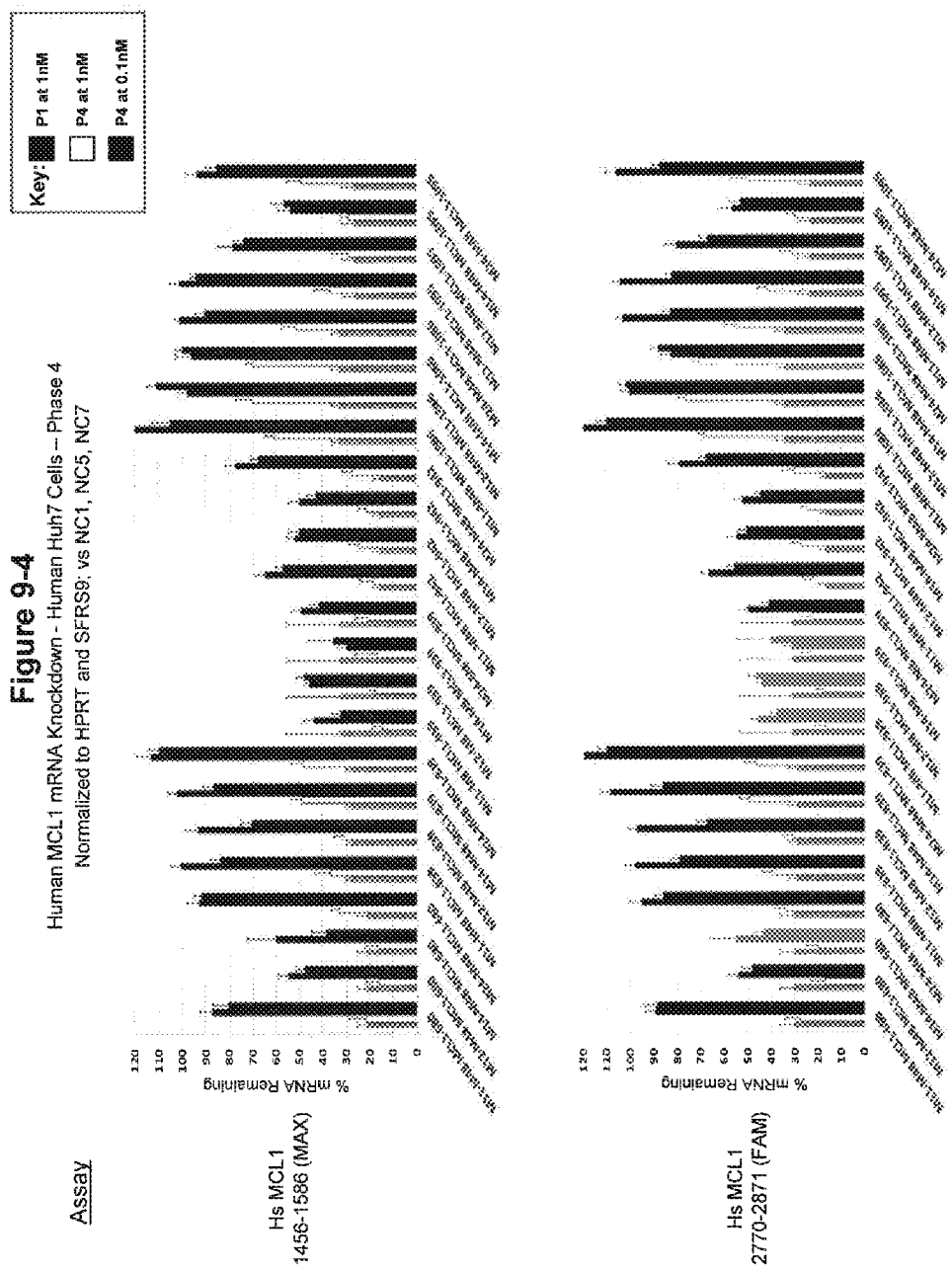

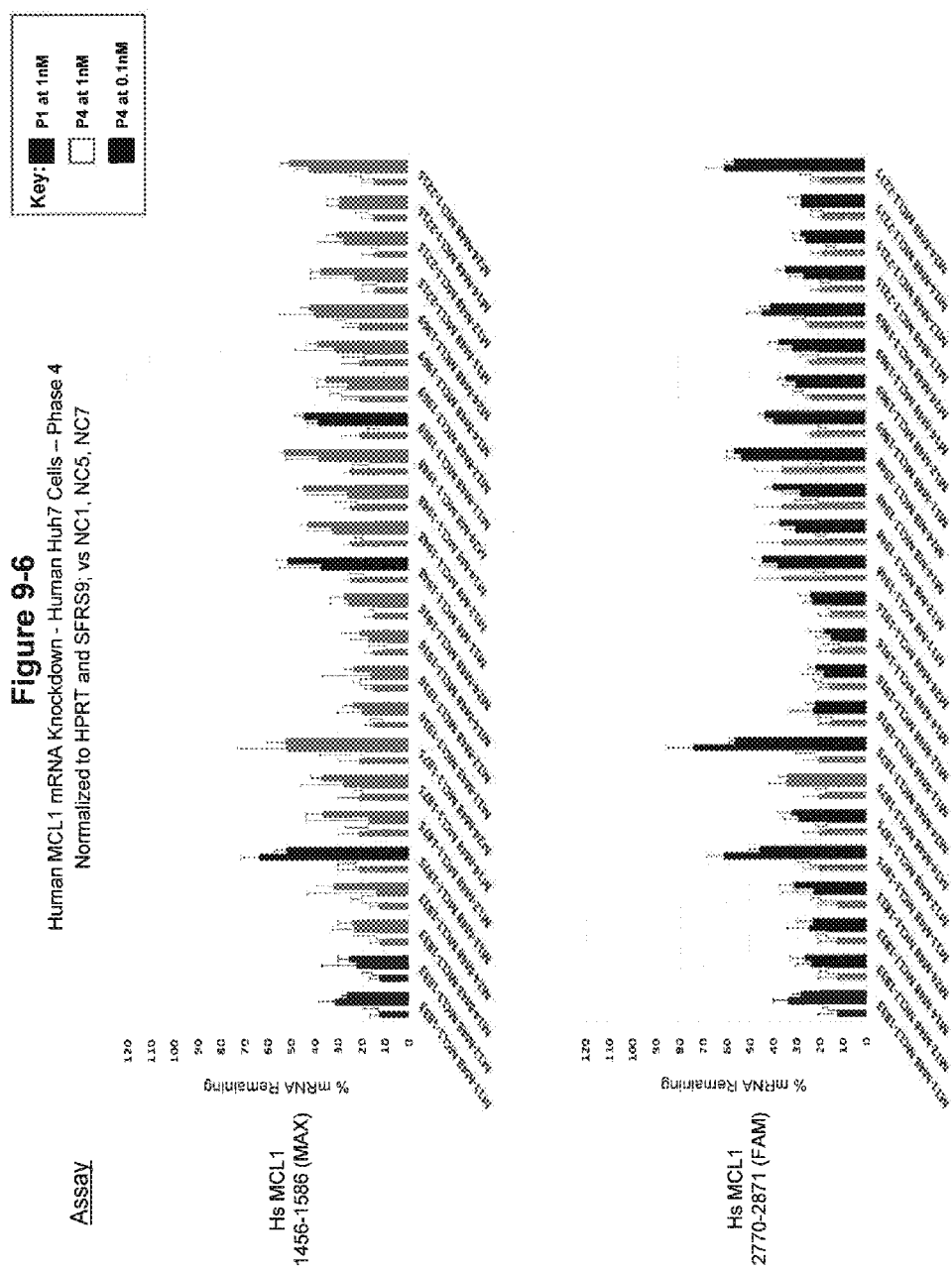

Human MCL1 mRNA Knockdown - Human Huh7 Cells – Phase 4
Normalized to HPRT and SFRS9, vs NC1, NC5, NC7

METHODS AND COMPOSITIONS FOR THE SPECIFIC INHIBITION OF MCL1 BY DOUBLE-STRANDED RNA

CROSS-REFERENCE TO RELATED APPLICATIONS

The present application claims priority to, and the benefit under 35 U.S.C. §119(e) of, U.S. provisional patent application No. 61/612,037, filed Mar. 16, 2012, entitled "Methods and Compositions for the Specific Inhibition of MCL1 by Double-Stranded RNA". The entire teachings of this application are incorporated herein by reference.

FIELD OF THE INVENTION

The present invention relates to compounds, compositions, and methods for the study, diagnosis, and treatment of traits, diseases and conditions that respond to the modulation of Mcl-1 (induced myeloid leukemia cell differentiation protein) gene expression and/or activity.

BACKGROUND OF THE INVENTION

Dysregulation of apoptosis is involved in various pathological conditions. For example, many cancers are characterized by a defect in the apoptotic process, such that the number of dying cells in a tissue is decreased below its normal level, resulting in an imbalance of cell death and cell proliferation and consequent growth of a tumor. In addition, neurodegenerative diseases are believed to be caused, at least in part, due to the induction of apoptosis, which can result in death of neuronal cells.

Several gene products that modulate the apoptotic process have been identified. The Bcl-2 family of proteins, which plays an important role in regulating cell survival and cell death, can be divided into two groups, proapoptotic proteins (Bak and Bak) and antiapoptotic proteins (Bcl-2, Bcl-$x_L$, A1, Mcl-1, and Bcl-w; Adams et al. *Science* 281: 1322-1326; Henson et al. *Clin. Cancer Res.* 12: 845-853). Antiapoptotic family member Mcl-1 (encoded by the MCL1 gene) was first characterized from a myeloid leukemia cell line (ML-1) induced to differentiate along the monocytic lineage (Kozopas et al. *Proc. Natl. Acad. Sci. U.S.A.* 90: 3516-3520; Leuenroth et al. *J. Leukoc. Bioi.* 68: 158-166) and has since been shown to be expressed in a wide variety of tissues and neoplastic cells and to influence the development of numerous malignancies (Thallinger et al. *Clin. Cancer Res.* 10: 4185-4191).

The role of Mcl-1 in regulating cell fate has made it a target of interest in many studies of apoptosis and hyperproliferative diseases. Many reports have demonstrated the importance of inhibiting Mcl-1 expression to increase apoptosis and regulate neoplastic disease (see, e.g., U.S. Pat. No. 6,800,750 and WO 94/29330), and inhibition of Mcl-1 expression has been proposed and/or shown to increase apoptosis, decrease cell viability and/or decrease tumor weight of normal cells, cancer cell lines or xenograft tumors.

Certain groups have previously identified MCL1 as a target for antisense oligonucleotide or siRNA-based agents (see, e.g., U.S. Pat. No. 6,001,750; Henson et al. *Clin. Cancer Res.* 12:845-853, which disclosed a Mcl-1 antisense oligonucleotide that sensitized breast cancer cell lines to apoptosis; Selzer et al. *Mol. Med.* 8:877-884, that disclosed inhibition of Mcl-1 expression in melanoma cells using an antisense oligonucleotide targeting Mcl-1; Skvara et al. *Anticancer Res.* 25: 2697-2703, which showed a Mcl-1 antisense oligonucleotide that sensitized human melanoma cells to ionizing radiation-induced apoptosis; Sieghart et al. *J. Hepatol.* 44: 151-157, that found the Mcl-1 to be overexpressed in hepatocellular carcinoma cell lines and disclosed a Mcl-1 antisense oligonucleotide that decreased protein expression, increased apoptosis, decreased cell survival and sensitized HCC cells to chemotherapy; Song et al. *Cancer Biol. Ther.* 4: 267-276; Aichberger et al. *Blood* 105:3303-3011, disclosed a Mcl-1 antisense oligonucleotide and siRNA which inhibited expression of Mcl-1 in chronic myeloid leukemia (CML) cells and decreased cell viability, and that the Mcl-1 antisense oligonucleotide synergized with a BCRI ABL inhibitor (Imatinib) to produce growth arrest; Derenne et al. *Blood* 100: 194-199 and Zhang et al. *Blood* 99: 1885-1893) disclosed use of Mcl-1 antisense oligonucleotide to decrease expression of Mcl-1, decrease cell viability and increase apoptosis of multiple myeloma cells lines and primary cells; Michels et al. *Oncogene* 23: 4818-4827; Sly et al. *J. Immunol.* 170: 430-437; Liu et al. *J. Exp. Med* 194: 113-126; Moulding et al. *Blood* 96: 1756-1763; Leuenroth et al. *J Leukoc. Biol.* 68: 158-166; Thallinger et al. *Clin. Cancer Res.* 10: 4185-4191, disclosed an antisense oligonucleotide targeted to Mcl-1 which decreased expression of Mcl-1 in sarcoma xenotransplants and when used in combination with cyclophosphamide, reduced tumor weight and increased tumor cell apoptosis; and Thallinger et al. *J. Invest. Dermatol.* 120: 1081-1086, which showed a Mcl-1 antisense oligonucleotide administered systemically with or without dacarbazine in a human melanoma SCID mouse xenotransplantation model to have decreased target protein expression, increased apoptosis and decreased tumor weight).

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

Provided herein are improved dsRNA agents that target MCL1. In particular, DsiRNAs targeting MCL1 have been specifically exemplified.

BRIEF SUMMARY OF THE INVENTION

The present invention is directed to compositions that contain double stranded RNA ("dsRNA"), and methods for preparing them. The dsRNAs of the invention are capable of reducing the expression of a target MCL1 gene in a cell, either in vitro or in a mammalian subject.

In one aspect, the invention provides an isolated nucleic acid comprising an oligonucleotide strand of 15-35 nucleotides in length, wherein the oligonucleotide strand is sufficiently complementary to a target MCL1 mRNA sequence selected from Tables 16-18 along at least 15 nucleotides of the oligonucleotide strand length to reduce MCL1 target mRNA expression when the nucleic acid is introduced into a mammalian cell.

The invention also provides an isolated nucleic acid comprising an oligonucleotide strand of 19-35 nucleotides in length, wherein the oligonucleotide strand is sufficiently complementary to a target MCL1 mRNA sequence selected from Tables 19-21, along at least 19 nucleotides of the oligonucleotide strand length to reduce MCL1 target mRNA expression when the nucleic acid is introduced into a mammalian cell.

The invention thus provides oligonucleotides which include only an antisense strand, in that the antisense oligonucleotide may pair with its cognate sense sequence on a target mRNA, thereby to reduce expression of the target gene. The invention also provides double stranded oligonucleotides, which include both sense and antisense strands.

The invention also provides an isolated double stranded nucleic acid (dsNA) comprising first and second nucleic acid strands comprising RNA, the dsNA comprising at least 14 base-pairs between the first and second strands, wherein the first strand is 15-35 nucleotides in length and the second strand of the dsNA is 19-35 nucleotides in length, wherein the second oligonucleotide strand is sufficiently complementary to a target MCL1 mRNA sequence selected from Tables 22 and 23 along at least 15 nucleotides of the second oligonucleotide strand length to reduce MCL1 target mRNA expression when the double stranded nucleic acid is introduced into a mammalian cell.

The invention also provides an isolated double stranded ribonucleic acid (dsNA) comprising first and second nucleic acid strands, the dsNA comprising at least 14 base-pairs between the first and second strands, wherein the first strand is 15-35 nucleotides in length and the second strand of the dsNA is 19-35 nucleotides in length, wherein the second oligonucleotide strand is sufficiently complementary to a target MCL1 mRNA sequence selected from Tables 13-15 along at least 19 nucleotides of the second oligonucleotide strand length to reduce MCL1 target mRNA expression when the double stranded nucleic acid is introduced into a mammalian cell.

The invention also provides an isolated double stranded ribonucleic acid (dsNA) comprising first and second nucleic acid strands, the dsNA comprising at least 14 base-pairs between the first and second strands, wherein the first strand is 15-35 nucleotides in length and the second strand of the dsNA is 19-35 nucleotides in length, wherein the second oligonucleotide strand is sufficiently complementary to a target MCL1 mRNA sequence selected from Tables 13-15 along at least 19 nucleotides of the second oligonucleotide strand length to reduce MCL1 target mRNA expression, and wherein, starting from the 5' end of the MCL1 mRNA sequence selected from Tables 13-15 (position 1), mammalian Ago2 cleaves the mRNA at a site between positions 9 and 10 of the sequence, when the double stranded nucleic acid is introduced into a mammalian cell.

The invention also provides an isolated dsNA molecule, consisting of: (a) a sense region and an antisense region, wherein the sense region and the antisense region together form a duplex region consisting of 25-35 base pairs and the antisense region comprises a sequence that is the complement of a sequence selected from Table 6; and (b) from zero to two 3' overhang regions, wherein each overhang region is six or fewer nucleotides in length. Preferably, the dsNA has one or two 3' overhangs which are 4 nucleotides in length and/or the duplex region consists of 25-30 base pairs.

The invention also provides an isolated double stranded ribonucleic acid (dsNA) comprising first and second nucleic acid strands and a duplex region of at least 25 base pairs, wherein the first strand is 25-34 nucleotides in length and the second strand of the dsNA is 26-35 nucleotides in length and comprises 1-5 single-stranded nucleotides at its 3' terminus, wherein the second oligonucleotide strand is sufficiently complementary to a target MCL1 mRNA sequence selected from Table 6 along at least 19 nucleotides of the second oligonucleotide strand length to reduce MCL1 target gene expression when the double stranded nucleic acid is introduced into a mammalian cell.

The invention also provides an isolated double stranded ribonucleic acid (dsNA) comprising first and second nucleic acid strands and a duplex region of at least 25 base pairs, wherein the first strand is 25-34 nucleotides in length and the second strand of the dsNA is 26-35 nucleotides in length and comprises 1-5 single-stranded nucleotides at its 3' terminus, wherein the 3' terminus of the first oligonucleotide strand and the 5' terminus of the second oligonucleotide strand form a blunt end, and the second oligonucleotide strand is sufficiently complementary to a target MCL1 sequence selected from the group consisting of SEQ ID NOs: 1261-1460 and 2590-2684 along at least 19 nucleotides of the second oligonucleotide strand length to reduce MCL1 mRNA expression when the double stranded nucleic acid is introduced into a mammalian cell.

Preferably, for any of the above dsNAs, the first and second strands form base pairs among at least 25 base pairs; 19-21 base pairs and 21-25 base pairs of the strands.

Preferably, for any of the above dsNAs, the first and second strands the second oligonucleotide strand comprises 1-5 single-stranded nucleotides at its 3' terminus.

Preferably, for any of the above nucleic acids or dsNAs, a strand is 25-35 nucleotides in length.

Where the invention includes one strand only, the strand length may be a length as set forth below for either of the first or second strands.

The invention provides for an isolated dsNA wherein the first strand is 26-35 nucleotides in length, 27-35 nucleotides in length, 28-35 nucleotides in length, 29-35 nucleotides in length, 30-35 nucleotides in length, 31-35 nucleotides in length, 33-35 nucleotides in length, 34-35 nucleotides in length, 17-35 nucleotides in length, 19-35 nucleotides in length, 21-35 nucleotides in length, 23-35 nucleotides in length, 17-33 nucleotides in length, 17-31 nucleotides in length, 17-29 nucleotides in length, 17-27 nucleotides in length, 21-35 nucleotides in length or 19-33 nucleotides in length.

Preferably, for any of the above dsNAs, the second strand is 25-35 nucleotides in length, 26-35 nucleotides in length, 27-35 nucleotides in length, 28-35 nucleotides in length, 29-35 nucleotides in length, 30-35 nucleotides in length, 31-35 nucleotides in length, 33-35 nucleotides in length, 34-35 nucleotides in length, 21-35 nucleotides in length, 23-35 nucleotides in length, 25-35 nucleotides in length, 27-35 nucleotides in length, 19-33 nucleotides in length, 19-31 nucleotides in length, 19-29 nucleotides in length, 19-27 nucleotides in length or 19-25 nucleotides in length.

Preferably, for any of the above dsNAs, the second oligonucleotide strand is complementary to a target MCL1 cDNA sequence selected from the group consisting of GenBank Accession Nos. NM_001530.3 and NM_181054.2 along at most 27 nucleotides of the second oligonucleotide strand length.

Preferably, for any of the above dsNAs, starting from the first nucleotide (position 1) at the 3' terminus of the first oligonucleotide strand, position 1, 2 and/or 3 is substituted with a modified nucleotide.

Preferably, for any of the above dsNAs, the 3' terminus of the first strand and the 5' terminus of the second strand form a blunt end.

Preferably, for any of the above dsNAs, the first strand is 25 nucleotides in length and the second strand is 27 nucleotides in length.

Preferably, for any of the above dsNAs, starting from the 5' end of a MCL1 mRNA sequence selected from Table 10 (position 1), mammalian Ago2 cleaves the mRNA at a site between positions 9 and 10 of the sequence, thereby reducing MCL1 target mRNA expression when the double stranded nucleic acid is introduced into a mammalian cell.

Preferably, for any of the above dsNAs, starting from the 5' end of the MCL1 mRNA sequence selected from SEQ ID NOs: 1261-1460 and 2590-2684, mammalian Ago2 cleaves the mRNA at a site between positions 9 and 10 of the cDNA sequence, thereby reducing MCL1 target mRNA expression when the double stranded nucleic acid is introduced into a mammalian cell.

Preferably, for any of the above dsNAs, the second strand comprises a sequence selected from the group consisting of SEQ ID NOs: 316-515 and 2302-2396.

Preferably, for any of the above dsNAs the first strand comprises a sequence selected from the group consisting of SEQ ID NOs: 1-200 and 2206-2300.

Preferably, any of the above dsNAs comprises a pair of first strand/second strand sequences selected from Table 2.

Preferably, for any of the above dsNAs, each of the first and the second strands has a length which is at least 26 nucleotides.

The invention also provides for an isolated dsNA, wherein each of the first and the second strands has a length which is at least 27 nucleotides, at least 28 nucleotides, at least 29 nucleotides, at least 30 nucleotides, at least 31 nucleotides, at least 32 nucleotides, at least 33 nucleotides, at least 34 nucleotides or at least 35 nucleotides Preferably, for any of the above dsNAs, wherein the modified nucleotide residue of the 3' terminus of the first strand is selected from the group consisting of a deoxyribonucleotide, an acyclonucleotide and a fluorescent molecule. Preferably, wherein position 1 of the 3' terminus of the first oligonucleotide strand is a deoxyribonucleotide.

Preferably, for any of the above dsNAs wherein the nucleotides of the 1-5 single-stranded nucleotides of the 3' terminus of the second strand comprise a modified nucleotide. Preferably, the modified nucleotide of the 1-5 single-stranded nucleotides of the 3' terminus of the second strand is a 2'-O-methyl ribonucleotide. Preferably, all nucleotides of the 1-5 single-stranded nucleotides of the 3' terminus of the second strand are modified nucleotides.

Preferably, for any of the above dsNAs, the dsNA comprises a modified nucleotide. Preferably, the modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O—(N-methylcarbamate).

Preferably, the 1-5 single-stranded nucleotides of the 3' terminus of the second strand are 1-3 nucleotides in length.

Preferably, for any of the above dsNAs, the 1-5 single-stranded nucleotides of the 3' terminus of the second strand are 1-2 nucleotides in length.

Preferably, for any of the above dsNAs, the 1-5 single-stranded nucleotides of the 3' terminus of the second strand is two nucleotides in length and comprises a 2'-O-methyl modified ribonucleotide.

Preferably, for any of the above dsNAs, the second oligonucleotide strand comprises a modification pattern selected from the group consisting of AS-M1 to AS-M48 and AS-M1* to AS-M48*.

Preferably, for any of the above dsNAs, the first oligonucleotide strand comprises a modification pattern selected from the group consisting of SM1 to SM24.

Preferably, for any of the above dsNAs, each of the first and the second strands has a length which is at least 26 and at most 30 nucleotides.

The invention also provides for an isolated dsNA, wherein each of the first and the second strands has a length which is at least 27 and at most 30 nucleotides, at least 28 and at most 30 nucleotides and at least 29 and at most 30 nucleotides.

Preferably, for any of the above dsNAs, the dsNA is cleaved endogenously in the cell by Dicer.

Preferably, for any of the above nucleic acids or dsNAs, the amount of the isolated nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

Preferably, the isolated nucleic acid or dsNA possesses greater potency than an isolated 21mer siRNA directed to the identical at least 19 nucleotides of the target MCL1 mRNA in reducing target MCL1 mRNA expression when assayed in vitro in a mammalian cell at an effective concentration in the environment of a cell of 1 nanomolar or less.

Preferably, the isolated nucleic acid or dsNA is sufficiently complementary to the target MCL1 mRNA sequence to reduce MCL1 target mRNA expression by an amount (expressed by %) selected from the group consisting of at least 10%, at least 50%, at least 80-90%, at least 95%, at least 98%, and at least 99% when the double stranded nucleic acid is introduced into a mammalian cell.

The invention provides for an isolated dsNA that is sufficiently complementary to a target MCL1 mRNA sequence along at least 15, 16, 17, 18, 19, 20, 21, 22, 23, 24, 25 or more nucleotides of the second oligonucleotide strand length to reduce MCL1 target mRNA expression when the dsNA is introduced into a mammalian cell.

Preferably, for any of the above dsNAs the first and second strands are joined by a chemical linker.

Preferably, for any of the above dsNAs, the 3' terminus of the first strand and the 5' terminus of the second strand are joined by a chemical linker.

Preferably, for any of the above dsNAs, a nucleotide of the second or first strand is substituted with a modified nucleotide that directs the orientation of Dicer cleavage.

Preferably, those nucleic acid strands comprising a modified nucleotide, modified nucleotide is selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

Preferably, for any of the above nucleic acid or dsNAs, the strand comprises a phosphate backbone modification selected from the group consisting of a phosphonate, a phosphorothioate and a phosphotriester.

The modification may be selected from the group consisting of a morpholino nucleic acid and a peptide nucleic acid (PNA).

The invention also provides a method for reducing expression of a target MCL1 gene in a mammalian cell comprising contacting a mammalian cell in vitro with an isolated dsNA in an amount sufficient to reduce expression of a target MCL1 mRNA in the cell.

Preferably, target MCL1 mRNA expression is reduced by an amount (expressed by %) selected from the group consisting of at least 10%, at least 50% and at least 80-90%.

Preferably, MCL1 mRNA levels are reduced by an amount (expressed by %) of at least 90% at least 8 days after the cell is contacted with the dsNA.

Preferably, MCL1 mRNA levels are reduced by an amount (expressed by %) of at least 70% at least 10 days after the cell is contacted with the dsNA.

The invention also provides a method for reducing expression of a target MCL1 mRNA in a mammal comprising administering an isolated nucleic acid as described herein to a mammal in an amount sufficient to reduce expression of a target MCL1 mRNA in the mammal.

Preferably, the isolated nucleic acid is administered at a dosage selected from the group consisting of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

Preferably, the isolated nucleic acid possesses greater potency than isolated 21mer siRNAs directed to the identical at least 19 nucleotides of the target MCL1 mRNA in reducing target MCL1 mRNA expression when assayed in vitro in a mammalian cell at an effective concentration in the environment of the cell of 1 nanomolar or less.

Preferably, MCL1 mRNA levels are reduced in a tissue of the mammal by an amount (expressed by %) of at least 70% at least 3 days after the isolated dsNA is administered to the mammal.

The tissue may be liver tissue.

Preferably, the administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

The invention also provides a method for selectively inhibiting the growth of a cell comprising contacting a cell with an amount of an isolated nucleic acid described herein sufficient to inhibit the growth of the cell.

Preferably, the cell is a tumor cell of a subject.

Preferably, the cell is a tumor cell in vitro.

Preferably, the cell is a human cell.

The invention also provides a formulation comprising the isolated nucleic acid described here, wherein the nucleic acid is present in an amount effective to reduce target MCL1 mRNA levels when the nucleic acid is introduced into a mammalian cell in vitro by an amount (expressed by %) selected from the group consisting of at least 10%, at least 50% and at least 80-90%.

Preferably, the effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

The invention also provides a formulation comprising the isolated dsNA described herein, wherein the dsNA is present in an amount effective to reduce target MCL1 mRNA levels when the dsNA is introduced into a cell of a mammalian subject by an amount (expressed by %) selected from the group consisting of at least 10%, at least 50% and at least 80-90%.

Preferably, the effective amount is a dosage selected from the group consisting of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

Preferably, the dsNA possesses greater potency than an isolated 21mer siRNA directed to the identical at least 19 nucleotides of the target MCL1 mRNA in reducing target MCL1 mRNA levels when assayed in vitro in a mammalian cell at an effective concentration in the environment of a cell of 1 nanomolar or less.

The invention also provides a mammalian cell containing the isolated nucleic acid described herein.

The invention also provides a pharmaceutical composition comprising the isolated nucleic acid described herein and a pharmaceutically acceptable carrier.

The invention also provides a kit comprising the isolated nucleic acid described herein and instructions for its use.

The invention also provides a method for treating, preventing or ameliorating a symptom of an MCL1-associated disease or disorder in a subject comprising administering the isolated nucleic acid and a pharmaceutically acceptable carrier to the subject in an amount sufficient to treat, prevent or ameliorate the MCL1-associated disease or disorder in the subject, thereby treating, preventing or ameliorating the MCL1-associated disease or disorder in the subject.

Preferably, the MCL1-associated disease or disorder is selected from the group consisting of renal, breast, lung, ovarian, cervical, esophageal, oropharyngeal and pancreatic cancer.

The invention also provides a composition possessing MCL1 inhibitory activity consisting essentially of an isolated nucleic acid described herein.

The present invention is also directed to compounds, compositions, and methods relating to traits, diseases and conditions that respond to the modulation of expression and/or activity of genes involved in MCL1 gene expression pathways or other cellular processes that mediate the maintenance or development of such traits, diseases and conditions. In certain aspects, the invention relates to small nucleic acid molecules that are capable of being processed by the Dicer enzyme, such as Dicer substrate siRNAs (DsiRNAs) capable of mediating RNA interference (RNAi) against MCL1 gene expression. The anti-MCL1 dsRNAs of the invention are useful, for example, in providing compositions for treatment of traits, diseases and conditions that can respond to modulation of MCL1 in a subject, such as cancer and/or other proliferative diseases, disorders, or conditions. Efficacy, potency, toxicity and other effects of an anti-MCL1 dsRNA can be examined in one or more animal models of proliferative disease (exemplary animal models of proliferative disease are recited below).

BRIEF DESCRIPTION OF THE DRAWINGS

FIGS. 2-1 to 2-4 present primary screen data showing DsiRNA-mediated knockdown of human MCL1 (FIGS. 2-1 and 2-2) and mouse MCL1 (FIGS. 2-3 and 2-4) in human and mouse cells, respectively. For each DsiRNA tested, two or three independent qPCR amplicons were assayed (in human cells, amplicons "1456-1586" and "2770-2871" were assayed, while in mouse cells, amplicons "558-675", "975-1131" and "2340-2593" were assayed).

FIGS. 3-1 to 3-6 show histograms of human and mouse MCL1 inhibitory efficacies observed for indicated DsiRNAs. "P1" indicates phase 1 (primary screen), while "P2" indicates phase 2. In phase 1, DsiRNAs were tested at 1 nM in the environment of Huh7 cells (human cell assays; FIGS. 3-1 to 3-3) or mouse cells (Hepa 1-6 cell assays; FIGS. 3-4 to 3-6). In phase 2, DsiRNAs were tested at 1 nM, 0.3 nM and at 0.1 nM in the environment of Huh7 cells. Individual bars represent average human (FIGS. 3-1 to 3-3) or mouse (FIGS. 3-4 to 3-6) MCL1 levels observed in triplicate, with standard errors shown. Human MCL1 levels were normalized to HPRT and SFRS9 levels, while mouse MCL1 levels were normalized to HPRT and Rp123 levels.

FIGS. 4-1 to 4-16 present bar graphs showing efficacy data for eight independent MCL1-targeting DsiRNAs across eight different guide (antisense) strand 2'-O-methyl modification patterns ("M0" to "M7", respectively, as shown in FIGS. 4-1 to 4-8 and 4-9 to 4-16) in human Huh7 cells (FIGS. 4-1 to 4-8) and mouse Hepa 1-6 cells (FIGS. 4-9 to 4-16) at 0.1 nM, 0.3 nM and 1 nM.

FIG. 5 presents additional primary screen data showing DsiRNA-mediated knockdown of human MCL1 in human cells. For each DsiRNA tested, two independent qPCR amplicons were assayed (amplicons "1456-1586" and "2770-2871").

FIG. 6 shows histograms of human MCL1 inhibitory efficacies observed for indicated DsiRNAs. "P1" indicates phase 1 (primary screen), while "P2" indicates phase 2. In phase 1, DsiRNAs were tested at 1 nM in the environment of human Huh7 cells. In phase 2, DsiRNAs were tested at 1 nM and at 0.1 nM (in duplicate) in the environment of human Huh7 cells. Individual bars represent average human MCL1 levels observed in triplicate, with standard errors shown. Human MCL1 levels were normalized to HPRT and SFRS9 levels. For each DsiRNA tested, two independent qPCR amplicons were assayed (amplicons "1456-1586" and "2770-2871").

FIGS. 7-1 to 7-9 present bar graphs showing efficacy data for 24 MCL1-targeting DsiRNAs each possessing four different 2'-O-methyl guide strand modification patterns ("M3", "M8", "M12" and "M25", as depicted in FIG. 7-1) in human HeLa cells (FIGS. 7-2 to 7-5) and mouse Hepa1-6 cells (FIGS. 7-6 to 7-9) at 0.1 nM (in duplicate) and 1 nM.

FIGS. 8-1 and 8-2 present in vivo efficacy data for exemplary duplexes possessing 2'-O-methyl modification patterns of both guide and passenger strands (duplex modification patterns are shown in FIG. 8-1). Five modified forms of the MCL1-1916 duplex sequence and one modified form of the MCL1-942 duplex sequence were synthesized and were identified to have significantly reduced MCL1 mRNA levels (by greater than 50%, in certain cases by greater than 60%) in mouse livers harvested 72 hours after DsiRNA dosing. DsiRNAs were administered at 10 mg/kg in Invivofectamine® 2.0 and left and right panels provide different presentations of the same data. An HPRT1-targeting DsiRNA was included as a non-MCL1-targeting control.

FIGS. 9-1 to 9-7 present modification pattern schematics (FIGS. 9-1 to 9-3) and histograms (FIGS. 9-4 to 9-7) showing efficacy data for 24 MCL1-targeting DsiRNAs each possessing four different 2'-O-methyl passenger strand modification patterns ("M11", "M12", "M14" and "M24" as depicted in FIGS. 9-1 and 9-2) coupled with guide strand modification pattern "M48", in human Huh7 cells at 0.1 nM (in duplicate) and 1 nM (independent assays of phase 1 and phase 4).

DETAILED DESCRIPTION OF THE INVENTION

Figure 1:
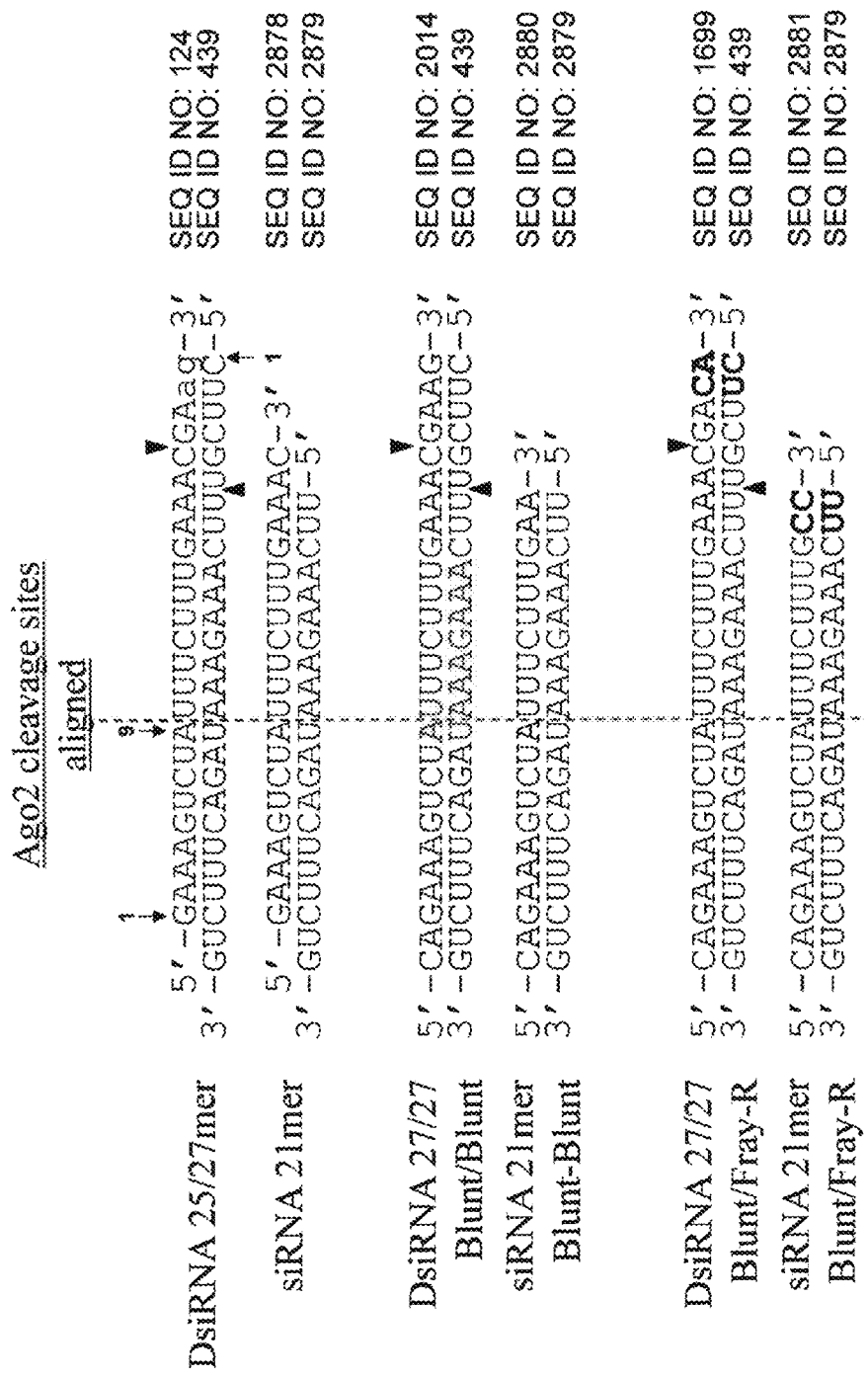
FIG. 1 shows the structures of exemplary DsiRNA agents of the invention targeting a site in the MCL1 RNA referred to herein as the "MCL1-1916" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted MCL1 sequence.

The present invention is directed to compositions that contain single or double stranded nucleic acids which include RNA residues (hereinafter variously referred to as, "nucleic acids", "dsNA" or "dsRNA"), and methods for preparing them, that are capable of reducing the level and/or expression of the MCL1 gene in vivo or in vitro. One of the strands of the dsRNA contains a region of nucleotide sequence that has a length that ranges from 19 to 35 nucleotides that can direct the destruction and/or translational inhibition of the targeted MCL1 transcript.

DEFINITIONS

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) MCL1 expression. The DsiRNAs of the invention optionally can be used in combination with modulators of other genes and/or gene products associated with the maintenance or development of diseases or disorders associated with MCL1 misregulation (e.g., tumor formation and/or growth, etc.). The DsiRNA agents of the invention modulate MCL1 RNAs such as those corresponding to the cDNA sequences referred to by GenBank Accession Nos. NM_021960.3 (human MCL1, transcript variant 1), NM_182763.2 (human MCL1, transcript variant 2), NM_001197320.1 (human MCL1, transcript variant 3), and NM_008562.3 (mouse MCL1), which are referred to herein generally as "MCL1."

The below description of the various aspects and embodiments of the invention is provided with reference to exemplary MCL1 RNAs, generally referred to herein as MCL1. However, such reference is meant to be exemplary only and the various aspects and embodiments of the invention are also directed to alternate MCL1 RNAs, such as mutant MCL1 RNAs or additional MCL1 splice variants. Certain aspects and embodiments are also directed to other genes involved in MCL1 pathways, including genes whose misregulation acts in association with that of MCL1 (or is affected or affects MCL1 regulation) to produce phenotypic effects that may be targeted for treatment (e.g., tumor formation and/or growth, etc.). BAK1, Noxa, BCL2L11, Bcl-2-associated death promoter, PCNA, DAD1, TNKS and BH3 interacting domain death agonist are examples of genes that interact with MCL1. Such additional genes, including those of pathways that act in coordination with MCL1, can be targeted using dsRNA and the methods described herein for use of MCL1-targeting dsRNAs. Thus, the inhibition and the effects of such inhibition of the other genes can be performed as described herein.

The term "MCL1" refers to nucleic acid sequences encoding a Mcl-1 protein, peptide, or polypeptide (e.g., MCL1 transcripts, such as the sequences of MCL1 Genbank Accession Nos. NM_021960.3, NM_182763.2, NM_001197320.1 and NM_008562.3). In certain embodiments, the term "MCL1" is also meant to include other MCL1 encoding sequence, such as other MCL1 isoforms, mutant MCL1 genes, splice variants of MCL1 genes, and MCL1 gene polymorphisms. The term "MCL1" is also used to refer to the polypeptide gene product of a MCL1 gene/transcript, e.g., a Mcl-1 protein, peptide, or polypeptide, such as those encoded by MCL1 Genbank Accession Nos. NP_068779.1, NP_877495.1, NP_001184249.1 and NP_032588.1.

As used herein, a "MCL1-associated disease or disorder" refers to a disease or disorder known in the art to be associated with altered MCL1 expression, level and/or activity. Notably, a "MCL1-associated disease or disorder" includes cancer and/or proliferative diseases, conditions, or disorders. Certain exemplary "MCL1-associated disease or disorders" include liver cancer (e.g. hepatocellular carcinoma or HCC), lung cancer (e.g., NSCLC), colorectal cancer, prostate cancer, pancreatic cancer, ovarian cancer, cervical cancer, brain cancer (e.g., glioblastoma), renal cancer (e.g., papillary renal carcinoma), stomach cancer, esophageal cancer, medulloblastoma, thyroid carcinoma, rhabdomyosarcoma, osteosarcoma, squamous cell carcinoma (e.g., oral squamous cell carcinoma), melanoma, breast cancer, and hematopoietic disorders (e.g., leukemias and lymphomas, and other immune cell-related disorders). Other hyperproliferative diseases or disorders may also be targeted, including, e.g., bladder, cervical (uterine), endometrial (uterine), head and neck, and oropharyngeal cancers.

By "proliferative disease" or "cancer" as used herein is meant, a disease, condition, trait, genotype or phenotype characterized by unregulated cell growth or replication as is known in the art; including hepatocellular carcinoma (HCC), leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of a MCL1 target sequence is assessed. In such embodiments, MCL1 RNA levels can be assessed by art-recognized methods (e.g., RT-PCR, Northern blot, expression array, etc.), optionally via comparison of MCL1 levels in the presence of an anti-MCL1 dsRNA of the invention relative to the absence of such an anti-MCL1 dsRNA. In certain embodiments, MCL1 levels in the presence of an anti-MCL1 dsRNA are compared to those observed in the presence of vehicle alone, in the presence of a dsRNA directed against an unrelated target RNA, or in the absence of any treatment.

It is also recognized that levels of Mcl-1 protein can be assessed and that Mcl-1 protein levels are, under different conditions, either directly or indirectly related to MCL1 RNA levels and/or the extent to which a dsRNA inhibits MCL1 expression, thus art-recognized methods of assessing Mcl-1 protein levels (e.g., Western blot, immunoprecipitation, other antibody-based methods, etc.) can also be employed to examine the inhibitory effect of a dsRNA of the invention.

An anti-MCL1 dsRNA of the invention is deemed to possess "MCL1 inhibitory activity" if a statistically significant reduction in MCL1 RNA (or when the Mcl-1 protein is assessed, Mcl-1 protein levels) is seen when an anti-MCL1 dsRNA of the invention is administered to a system (e.g., cell-free in vitro system), cell, tissue or organism, as compared to a selected control. The distribution of experimental values and the number of replicate assays performed will tend to dictate the parameters of what levels of reduction in MCL1 RNA (either as a % or in absolute terms) is deemed statistically significant (as assessed by standard methods of determining statistical significance known in the art). However, in certain embodiments, "MCL1 inhibitory activity" is defined based upon a % or absolute level of reduction in the level of MCL1 in a system, cell, tissue or organism. For example, in certain embodiments, a dsRNA of the invention is deemed to possess MCL1 inhibitory activity if at least a 5% reduction or at least a 10% reduction in MCL1 RNA is observed in the presence of a dsRNA of the invention relative to MCL1 levels seen for a suitable control. (For example, in vivo MCL1 levels in a tissue and/or subject can, in certain embodiments, be deemed to be inhibited by a dsRNA agent of the invention if, e.g., a 5% or 10% reduction in MCL1 levels is observed relative to a control.) In certain other embodiments, a dsRNA of the invention is deemed to possess MCL1 inhibitory activity if MCL1 RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of MCL1 is required for a dsRNA to be deemed to possess MCL1 inhibitory activity. In certain models (e.g., cell culture), a dsRNA is deemed to possess MCL1 inhibitory activity if at least a 50% reduction in MCL1 levels is observed relative to a suitable control. In certain other embodiments, a dsRNA is deemed to possess MCL1 inhibitory activity if at least an 80% reduction in MCL1 levels is observed relative to a suitable control.

By way of specific example, in Example 2 below, a series of DsiRNAs targeting MCL1 were tested for the ability to reduce MCL1 mRNA levels in human Huh7 or mouse Hepa 1-6 cells in vitro, at 1 nM concentrations in the environment of such cells and in the presence of a transfection agent (Lipofectamine™ RNAiMAX, Invitrogen). Within Example 2 below, MCL1 inhibitory activity was ascribed to those DsiRNAs that were observed to effect at least a 70% reduction of MCL1 mRNA levels under the assayed conditions. It is contemplated that MCL1 inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess MCL1 inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in MCL1 mRNA levels is observed in a mammalian cell line in vitro at 1 nM dsRNA concentration or lower in the environment of a cell, relative to a suitable control.

Use of other endpoints for determination of whether a double stranded RNA of the invention possesses MCL1 inhibitory activity is also contemplated. Specifically, in one embodiment, in addition to or as an alternative to assessing MCL1 mRNA levels, the ability of a tested dsRNA to reduce Mcl-1 protein levels (e.g., at 48 hours after contacting a mammalian cell in vitro or in vivo) is assessed, and a tested dsRNA is deemed to possess MCL1 inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in Mcl-1 protein levels is observed in a mammalian cell contacted with the assayed double stranded RNA in vitro or in vivo, relative to a suitable control. Additional endpoints contemplated include, e.g., assessment of a phenotype associated with reduction of MCL1 levels—e.g., reduction of growth of a contacted mammalian cell line in vitro and/or reduction of growth of a tumor in vivo, including, e.g., halting or reducing the growth of tumor or cancer cell levels as described in greater detail elsewhere herein.

MCL1 inhibitory activity can also be evaluated over time (duration) and over concentration ranges (potency), with assessment of what constitutes a dsRNA possessing MCL1 inhibitory activity adjusted in accordance with concentrations administered and duration of time following administration. Thus, in certain embodiments, a dsRNA of the invention is deemed to possess MCL1 inhibitory activity if at least a 50% reduction in MCL1 activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent MCL1 inhibitory agent if MCL1 inhibitory activity (e.g., in certain embodiments, at least 50% inhibition of MCL) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for MCL1 inhibitory activity as described herein. In certain embodiments, a potent MCL1 inhibitory dsRNA of the invention is defined as one that is capable of MCL1 inhibitory activity (e.g., in certain embodiments, at least 20% reduction of MCL1 levels) at a formulated concentration of 10 mg/kg or less when administered to a subject in an effective delivery vehicle (e.g., an effective lipid nanoparticle formulation). Preferably, a potent MCL1 inhibitory dsRNA of the invention is defined as one that is capable of MCL1 inhibitory activity (e.g., in certain embodiments, at least 50% reduction of MCL1 levels) at a formulated concentration of 5 mg/kg or less when administered to a subject in an effective delivery vehicle. More preferably, a potent MCL1 inhibitory dsRNA of the invention is defined as one that is capable of MCL1 inhibitory activity (e.g., in certain embodiments, at least 50% reduction of MCL1 levels) at a formulated concentration of 5 mg/kg or less when administered to a subject in an effective delivery vehicle. Optionally, a potent MCL1 inhibitory dsRNA of the invention is defined as one that is capable of MCL1 inhibitory activity (e.g., in certain embodiments, at least 50% reduction of MCL1 levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

MCL1 inhibitory levels and/or MCL1 levels may also be assessed indirectly, e.g., measurement of a reduction of the size, number and/or rate of growth or spread of polyps or tumors in a subject may be used to assess MCL1 levels and/or MCL1 inhibitory efficacy of a double-stranded nucleic acid of the instant invention.

In certain embodiments, the phrase "consists essentially of" is used in reference to the anti-MCL1 dsRNAs of the invention. In some such embodiments, "consists essentially of" refers to a composition that comprises a dsRNA of the invention which possesses at least a certain level of MCL1 inhibitory activity (e.g., at least 50% MCL1 inhibitory activity) and that also comprises one or more additional components and/or modifications that do not significantly impact the MCL1 inhibitory activity of the dsRNA. For example, in certain embodiments, a composition "consists essentially of" a dsRNA of the invention where modifications of the dsRNA of the invention and/or dsRNA-associated components of the composition do not alter the MCL1 inhibitory activity (optionally including potency or duration of MCL1 inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of MCL1 inhibitory activity (e.g., 80% reduction, 90% reduction, etc. in efficacy, duration and/or potency) occurs in the presence of additional components or modifications, yet where MCL1 inhibitory activity is not significantly elevated (e.g., observed levels of MCL1 inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other, see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-$CH_2$—O-2'-bridge, 4'-$(CH_2)_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-$NH_2$ or 2'-O—$NH_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., Nature 1990 Aug. 16; 346(6285):680-2; Heus and Pardi, Science 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the MCL1 gene/RNA.

An anti-MCL1 DsiRNA of the instant invention possesses strand lengths of at least 25 nucleotides. Accordingly, in certain embodiments, an anti-MCL1 DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-MCL1 DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-MCL1 DsiRNA agent is comprised of two oligonucleotide strands of differing lengths, with the anti-MCL1 DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., MCL1 mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-MCL1 DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5'end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

otides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dice" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-

TABLE 1

|  | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O |  | Sigma | W-4502 | 51K2359 |  | to 50 mL |
| pH = 7.0 at 20° C. |  |  |  | adjust with HCl |  |  |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonuclebase overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the MCL1 target gene in a cell or mammal, wherein the dsRNA comprises an antisense strand comprising a region of complementarity which is complementary to at least a part of an mRNA formed in the expression of the MCL1 target gene, and wherein the region of complementarity is less than 35 nucleotides in length, optionally 19-24 nucleotides in length or 25-30 nucleotides in length, and wherein the dsRNA, upon contact with a cell expressing the MCL1 target gene, inhibits the expression of the MCL1 target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the MCL1 target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., EMBO 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 6, minus only a few nucleotides on one or both ends may be similarly effective as compared to the dsRNAs described above and in Tables 2-5 and 7-10. Hence, dsRNAs comprising a partial sequence of at least 15, 16, 17, 18, 19, 20, or more contiguous nucleotides sufficiently complementary to one of the sequences of Table 6, and differing in their ability to inhibit the expression of the MCL1 target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase TI, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of MCL1 possessing perfect complementarity with the presently described dsRNA agents, but also against target MCL1 RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target MCL1 RNA, e.g., of a specific allelic variant of MCL1 (e.g., an allele of enhanced therapeutic interest). Indeed, dsRNA agent sequences with insertions, deletions, and single point mutations relative to the target MCL1 sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment the alignment is optimized is formed by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized is formed by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the MCL1 RNA sequence is preferred. Alternatively, the dsRNA may be defined functionally as a nucleotide sequence (or oligonucleotide sequence) that is capable of hybridizing with a portion of the MCL1 RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target MCL1, in certain embodiments, the target nucleic acid is MCL1 RNA, e.g., in certain embodiments, MCL1 mRNA. MCL1 RNA target sites can also interchangeably be referenced by corresponding cDNA sequences. Levels of MCL1 may also be targeted via targeting of upstream effectors of MCL1, or the effects of modulated or misregulated MCL1 may also be modulated by targeting of molecules downstream of MCL1 in the MCL1 signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, dsRNA molecules of the invention that down regulate or reduce MCL1 gene expression are used for treating, preventing or reducing MCL1-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (MCL1) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA intereference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing MCL1 target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-MCL1 Single-Stranded or DsiRNA Agents (while the Structures Set Forth Below are Duplex Structures, the Invention Contemplates Single-Stranded Oligonucleotides in Some Embodiments, and Those May be Represented as the Antisense Strand, with Orientation to the mRNA (Sense Strand) Target, in the Duplex Structures Described Herein.)

In certain embodiments, the anti-MCL1 DsiRNA agents of the invention can have the following structures:

In one such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA and "Y" is an overhang domain comprised of 1-4 RNA monomers that are optionally 2'-O-methyl RNA monomers. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. In a further related embodiment, the DsiRNA comprises:

```
5'-XXXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

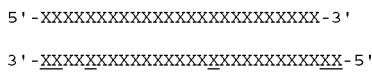

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

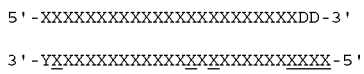

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

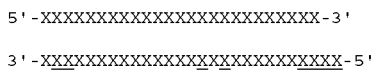

wherein "X"=RNA and "X"=2'-O-methyl RNA. The top strand is the sense strand, and the bottom strand is the antisense strand. In a further related embodiment, the DsiRNA comprises:

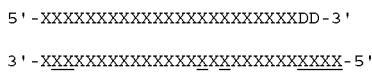

wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

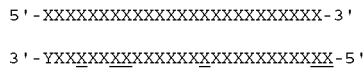

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

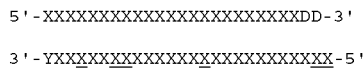

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

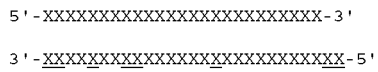

wherein "X"=RNA and "X"=2'-O-methyl RNA. The top strand is the sense strand, and the bottom strand is the antisense strand. In a further related embodiment, the DsiRNA comprises:

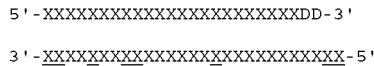

wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

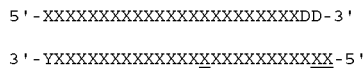

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

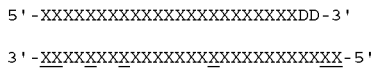

wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

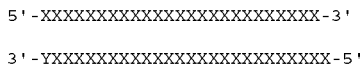

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

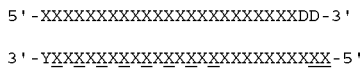

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

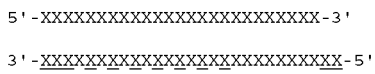

wherein "X"=RNA and "X"=2'-O-methyl RNA. The top strand is the sense strand, and the bottom strand is the antisense strand. In a further related embodiment, the DsiRNA comprises:

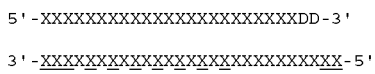

wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

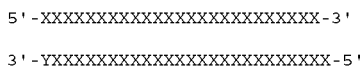

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

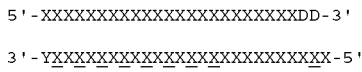

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

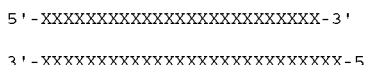

wherein "X"=RNA and "X"=2'-O-methyl RNA. The top strand is the sense strand, and the bottom strand is the antisense strand. In a further related embodiment, the DsiRNA comprises:

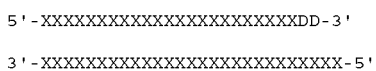

wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

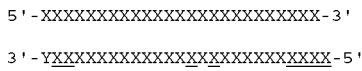

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

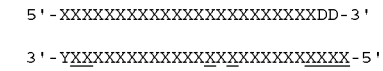

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

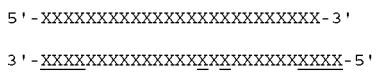

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXX-3'
3'-YXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

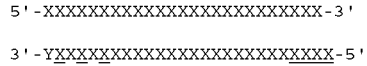

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

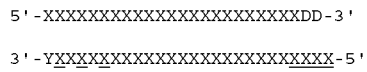

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

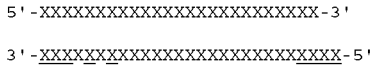

wherein "X"=RNA and "X̲"=2'-O-methyl RNA. The top strand is the sense strand, and the bottom strand is the antisense strand. In a further related embodiment, the DsiRNA comprises:

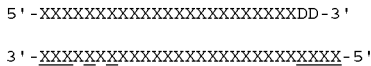

wherein "X"=RNA, "X̲"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

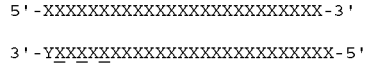

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

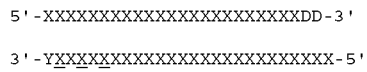

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

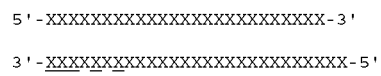

wherein "X"=RNA and "X̲"=2'-O-methyl RNA. The top strand is the sense strand, and the bottom strand is the antisense strand. In a further related embodiment, the DsiRNA comprises:

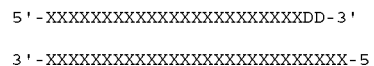

wherein "X"=RNA, "X̲"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

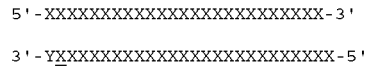

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

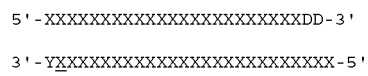

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

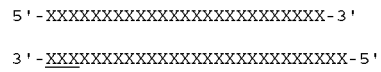

wherein "X"=RNA and "X̲"=2'-O-methyl RNA. The top strand is the sense strand, and the bottom strand is the antisense strand. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

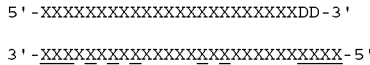

wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

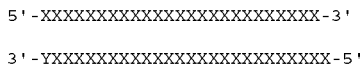

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

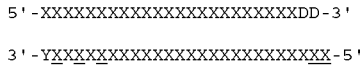

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

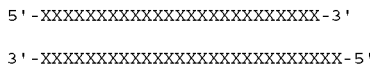

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

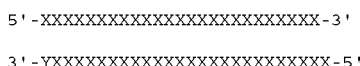

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

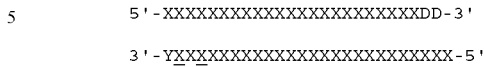

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

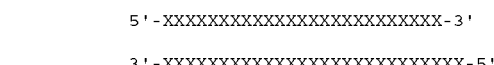

wherein "X"=RNA and "X"=2'-O-methyl RNA. The top strand is the sense strand, and the bottom strand is the antisense strand. In a further related embodiment, the DsiRNA comprises:

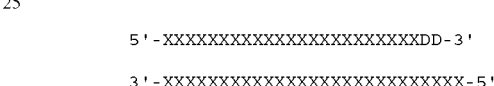

wherein "X"=RNA, "X"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

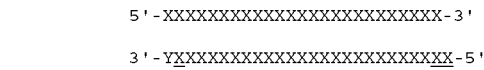

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

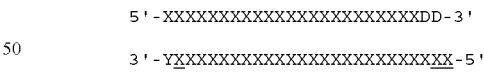

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

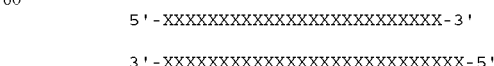

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

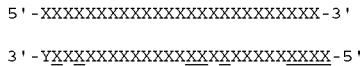

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

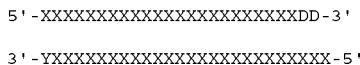

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

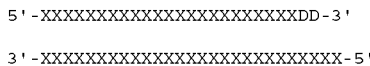

wherein "X"=RNA, "X̲"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

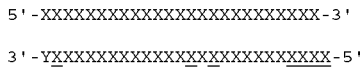

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

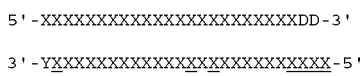

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

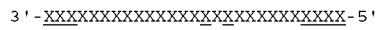

wherein "X"=RNA and "X̲"=2'-O-methyl RNA. The top strand is the sense strand, and the bottom strand is the antisense strand. In a further related embodiment, the DsiRNA comprises:

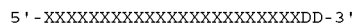
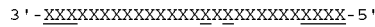

wherein "X"=RNA, "X̲"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

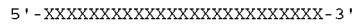
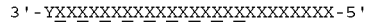

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

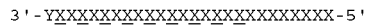

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

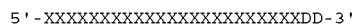
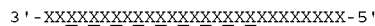

wherein "X"=RNA, "X̲"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

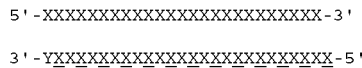

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

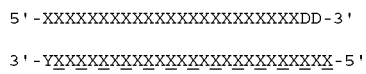

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

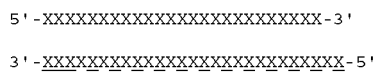

wherein "X"=RNA and "X̲"=2'-O-methyl RNA. The top strand is the sense strand, and the bottom strand is the antisense strand. In a further related embodiment, the DsiRNA comprises:

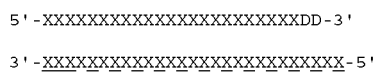

wherein "X"=RNA, "X̲"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

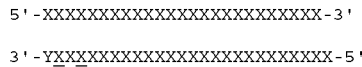

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

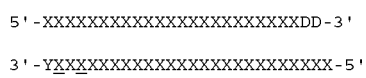

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

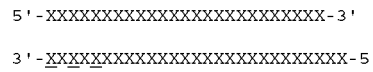

wherein "X"=RNA and "X̲"=2'-O-methyl RNA. The top strand is the sense strand, and the bottom strand is the antisense strand. In a further related embodiment, the DsiRNA comprises:

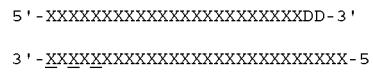

wherein "X"=RNA, "X̲"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

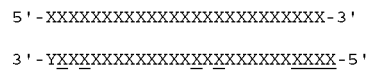

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

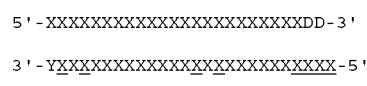

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

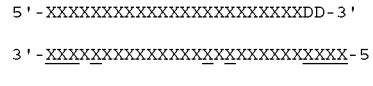

wherein "X"=RNA, "X̲"=2'-O-methyl RNA, and "D"=DNA. The top strand is the sense strand, and the bottom strand is the antisense strand. This modification pattern is also referred to herein as the "AS-M48" or "M48" modification pattern.

In additional embodiments, the DsiRNA comprises:

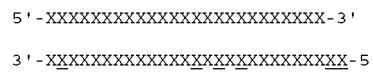

wherein "X"=RNA and "X"=2'-O-methyl RNA. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

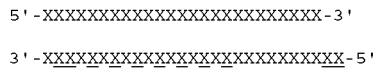

wherein "X"=RNA and "X"=2'-O-methyl RNA. The top strand is the sense strand, and the bottom strand is the antisense strand. In a further related embodiment, the DsiRNA comprises:

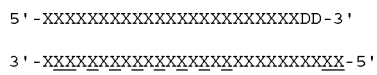

wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

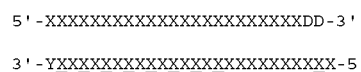

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

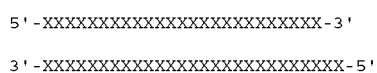

wherein "X"=RNA and "X"=2'-O-methyl RNA. The top strand is the sense strand, and the bottom strand is the antisense strand. In a further related embodiment, the DsiRNA comprises:

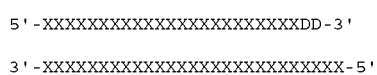

wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

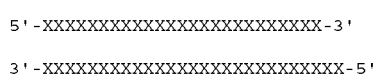

wherein "X"=RNA and "X"=2'-O-methyl RNA. The top strand is the sense strand, and the bottom strand is the antisense strand. In a further related embodiment, the DsiRNA comprises:

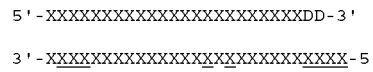

wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

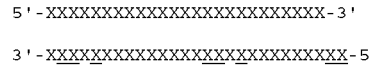

wherein "X"=RNA and "X"=2'-O-methyl RNA. The top strand is the sense strand, and the bottom strand is the antisense strand. In a further related embodiment, the DsiRNA comprises:

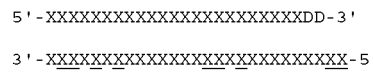

wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

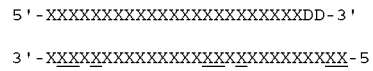

wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

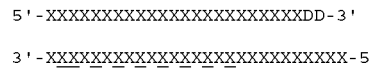

wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXXDD-3'  "SM1"

5'-XXXXXXXXXXXXXXXXXXXXXXXXXDD-3'  "SM2"
```

-continued
```
5'-XXXXXXXXXXXXXXXXXXXXXXXXXDD-3'  "SM3"

5'-XXXXXXXXXXXXXXXXXXXXXXXXXDD-3'  "SM4"

5'-XXXXXXXXXXXXXXXXXXXXXXXXXDD-3'  "SM5"

5'-XXXXXXXXXXXXXXXXXXXXXXXXXDD-3'  "SM6"

5'-XXXXXXXXXXXXXXXXXXXXXXXXXDD-3'  "SM7"

5'-XXXXXXXXXXXXXXXXXXXXXXXXXDD-3'  "SM8"

5'-XXXXXXXXXXXXXXXXXXXXXXXXXDD-3'  "SM9"

5'-XXXXXXXXXXXXXXXXXXXXXXXXXDD-3'  "SM10"

5'-XXXXXXXXXXXXXXXXXXXXXXXXXDD-3'  "SM11"

5'-XXXXXXXXXXXXXXXXXXXXXXXXXDD-3'  "SM12"

5'-XXXXXXXXXXXXXXXXXXXXXXXXXDD-3'  "SM13"

5'-XXXXXXXXXXXXXXXXXXXXXXXXXDD-3'  "SM14"

5'-XXXXXXXXXXXXXXXXXXXXXXXXXDD-3'  "SM15"

5'-XXXXXXXXXXXXXXXXXXXXXXXXXDD-3'  "SM16"

5'-XXXXXXXXXXXXXXXXXXXXXXXXXDD-3'  "SM17"

5'-XXXXXXXXXXXXXXXXXXXXXXXXXDD-3'  "SM18"

5'-XXXXXXXXXXXXXXXXXXXXXXXXXDD-3'  "SM19"

5'-XXXXXXXXXXXXXXXXXXXXXXXXXDD-3'  "SM20"

5'-XXXXXXXXXXXXXXXXXXXXXXXXXDD-3'  "SM21"

5'-XXXXXXXXXXXXXXXXXXXXXXXXXDD-3'  "SM23"

5'-XXXXXXXXXXXXXXXXXXXXXXXXXDD-3'  "SM24"

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'
```

```
5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'  "SM22"
where "X" = RNA, "X" = 2'-O-methyl RNA, and "D" = DNA.
```

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

```
5'-XXXXXXXXXXXXXXXXXXXXXXXXXX$M_M$-3'
3'-XXXXXXXXXXXXXXXXXXXXXXXXXX$M_M$-5'
``` wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

```
5'-XXXXXXXXXXXXXXXXXXXXXXXXXXX$_{N*}$D$_N$DD-3'

3'-YXXXXXXXXXXXXXXXXXXXXXXXXXX$_{N*}$D$_N$XX-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

```
5'-XXXXXXXXXXXXXXXXXXXXXXXXXXX$_{N*}$D$_N$DD-3'

3'-YXXXXXXXXXXXXXXXXXXXXXXXXXX$_{N*}$D$_N$DD-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

```
5'-XXXXXXXXXXXXXXXXXXXXXXXXXXX$_{N*}$D$_N$DD-3'

3'-YXXXXXXXXXXXXXXXXXXXXXXXXXX$_{N*}$D$_N$ZZ-5'
``` wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

```
5'-XXXXXXXXXXXXXXXXXXXXXXXXXXX$_{N*}$D$_N$DD-3'

3'-YXXXXXXXXXXXXXXXXXXXXXXXXXX$_{N*}$D$_N$ZZ-5'
``` wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

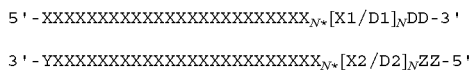

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

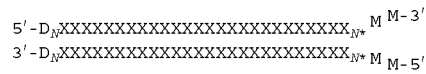

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=−0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

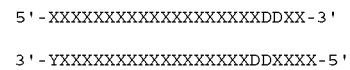

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

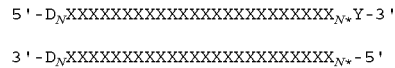

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

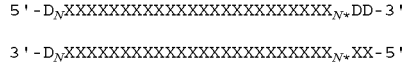

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

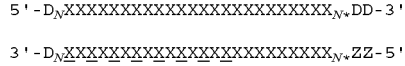

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

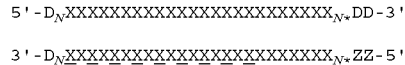

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

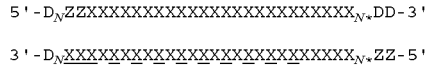

wherein "X"=RNA, "X"=2'-O-methyl RNA, "D"=DNA, "Z"=DNA or RNA, and "N"=1 to 50 or more, but is optionally 1-8 or 1-10. "N*"=-0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

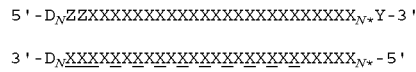

wherein "X"=RNA, "X"=2'-O-methyl RNA, "D"=DNA, "Z"=DNA or RNA, and "N"=1 to 50 or more, but is optionally 1-8 or 1-10. "N*"=-0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

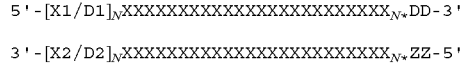

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=-0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

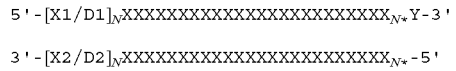

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

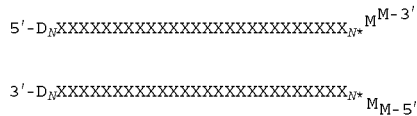

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA: DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

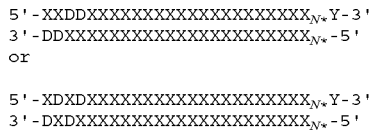

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary MCL1 targeting DsiRNA agents of the invention, and their associated MCL1 target sequences, include the following, presented in the below series of tables: Table Number:

(2) Selected Human Anti-MCL1 DsiRNA Agents (Asymmetrics);
(3) Selected Human Anti-MCL1 DsiRNAs, Unmodified Duplexes (Asymmetrics);
(4) Selected Mouse Anti-MCL1 DsiRNAs (Asymmetrics);
(5) Selected Mouse Anti-MCL1 DsiRNAs, Unmodified Duplexes (Asymmetrics);
(6) DsiRNA Target Sequences (21mers) In MCL1;
(7) Selected Human Anti-MCL1 "Blunt/Fray" DsiRNAs;
(8) Selected Mouse Anti-MCL1 "Blunt/Fray" DsiRNAs;
(9) Selected Human Anti-MCL1 "Blunt/Blunt" DsiRNAs; and
(10) Selected Mouse Anti-MCL1 "Blunt/Blunt" DsiRNAs.

TABLE 2

Selected Human Anti-MCL1 DsiRNA Agents (Asymmetrics)

|  |  |  |
|---|---|---|
|  | 5'-GCCACUUCUCACUUCCGCUUCCUtc-3' | (SEQ ID NO: 1) |
|  | 3'-AGCGGUGAAGAGUGAAGGCGAAGGAAG-5' | (SEQ ID NO: 316) |
| MCL1-72 Target: | 5'-TCGCCACTTCTCACTTCCGCTTCCTTC-3' | (SEQ ID NO: 631) |

TABLE 2-continued

Selected Human Anti-MCL1 DsiRNA Agents (Asymmetrics)

|  |  |  |
|---|---|---|
|  | 5'-ACUUCUCACUUCCGCUUCCUUCCag-3' | (SEQ ID NO: 2) |
|  | 3'-GGUGAAGAGUGAAGGCGAAGGAAGGUC-5' | (SEQ ID NO: 317) |
| MCL1-75 Target: | 5'-CCACTTCTCACTTCCGCTTCCTTCCAG-3' | (SEQ ID NO: 632) |
|  | 5'-GGCGGCGACUGGCAAUGUUUGGCct-3' | (SEQ ID NO: 3) |
|  | 3'-CGCCGCCGCUGACCGUUACAAACCGGA-5' | (SEQ ID NO: 318) |
| MCL1-141 Target: | 5'-GCGGCGGCGACTGGCAATGTTTGGCCT-3' | (SEQ ID NO: 633) |
|  | 5'-CGCGGUAAUCGGACUCAACCUCUac-3' | (SEQ ID NO: 4) |
|  | 3'-UUGCGCCAUUAGCCUGAGUUGGAGAUG-5' | (SEQ ID NO: 319) |
| MCL1-175 Target: | 5'-AACGCGGTAATCGGACTCAACCTCTAC-3' | (SEQ ID NO: 634) |
|  | 5'-AGGGCGACUUUUGGCUACGGAGAag-3' | (SEQ ID NO: 5) |
|  | 3'-CCUCCCGCUGAAAACCGAUGCCUCUUC-5' | (SEQ ID NO: 320) |
| MCL1-250 Target: | 5'-GGAGGGCGACTTTTGGCTACGGAGAAG-3' | (SEQ ID NO: 635) |
|  | 5'-GCGAGGCUGCUUUUCUUCGCGCCca-3' | (SEQ ID NO: 6) |
|  | 3'-GGCGCUCCGACGAAAAGAAGCGCGGGU-5' | (SEQ ID NO: 321) |
| MCL1-434 Target: | 5'-CCGCGAGGCTGCTTTTCTTCGCGCCCA-3' | (SEQ ID NO: 636) |
|  | 5'-UGGUAAUAACACCAGUACGGACGgg-3' | (SEQ ID NO: 7) |
|  | 3'-AGACCAUUAUUGUGGUCAUGCCUGCCC-5' | (SEQ ID NO: 322) |
| MCL1-604 Target: | 5'-TCTGGTAATAACACCAGTACGGACGGG-3' | (SEQ ID NO: 637) |
|  | 5'-GGAGGAGGACGAGUUGUACCGGCag-3' | (SEQ ID NO: 8) |
|  | 3'-CUCCUCCUCCUGCUCAACAUGGCCGUC-5' | (SEQ ID NO: 323) |
| MCL1-661 Target: | 5'-GAGGAGGAGGACGAGTTGTACCGGCAG-3' | (SEQ ID NO: 638) |
|  | 5'-CGGCAGUCGCUGGAGAUUAUCUCtc-3' | (SEQ ID NO: 9) |
|  | 3'-UGGCCGUCAGCGACCUCUAAUAGAGAG-5' | (SEQ ID NO: 324) |
| MCL1-680 Target: | 5'-ACCGGCAGTCGCTGGAGATTATCTCTC-3' | (SEQ ID NO: 639) |
|  | 5'-CAAGGACACAAAGCCAAUGGGCAgg-3' | (SEQ ID NO: 10) |
|  | 3'-CGGUUCCUGUGUUUCGGUUACCCGUCC-5' | (SEQ ID NO: 325) |
| MCL1-733 Target: | 5'-GCCAAGGACACAAAGCCAATGGGCAGG-3' | (SEQ ID NO: 640) |
|  | 5'-GGAAGGCGCUGGAGACCUUACGAcg-3' | (SEQ ID NO: 11) |
|  | 3'-GUCCUUCCGCGACCUCUGGAAUGCUGC-5' | (SEQ ID NO: 326) |
| MCL1-774 Target: | 5'-CAGGAAGGCGCTGGAGACCTTACGACG-3' | (SEQ ID NO: 641) |
|  | 5'-GGCGUGCAGCGCAACCACGAGACgg-3' | (SEQ ID NO: 12) |
|  | 3'-UACCGCACGUCGCGUUGGUGCUCUGCC-5' | (SEQ ID NO: 327) |
| MCL1-809 Target: | 5'-ATGGCGTGCAGCGCAACCACGAGACGG-3' | (SEQ ID NO: 642) |
|  | 5'-GCGUGCAGCGCAACCACGAGACGgc-3' | (SEQ ID NO: 13) |
|  | 3'-ACCGCACGUCGCGUUGGUGCUCUGCCG-5' | (SEQ ID NO: 328) |
| MCL1-810 Target: | 5'-TGGCGTGCAGCGCAACCACGAGACGGC-3' | (SEQ ID NO: 643) |
|  | 5'-CGUGCAGCGCAACCACGAGACGGcc-3' | (SEQ ID NO: 14) |
|  | 3'-CCGCACGUCGCGUUGGUGCUCUGCCGG-5' | (SEQ ID NO: 329) |
| MCL1-811 Target: | 5'-GGCGTGCAGCGCAACCACGAGACGGCC-3' | (SEQ ID NO: 644) |
|  | 5'-GUGCAGCGCAACCACGAGACGGCct-3' | (SEQ ID NO: 15) |
|  | 3'-CGCACGUCGCGUUGGUGCUCUGCCGGA-5' | (SEQ ID NO: 330) |
| MCL1-812 Target: | 5'-GCGTGCAGCGCAACCACGAGACGGCCT-3' | (SEQ ID NO: 645) |
|  | 5'-UGCAGCGCAACCACGAGACGGCCtt-3' | (SEQ ID NO: 16) |
|  | 3'-GCACGUCGCGUUGGUGCUCUGCCGGAA-5' | (SEQ ID NO: 331) |
| MCL1-813 Target: | 5'-CGTGCAGCGCAACCACGAGACGGCCTT-3' | (SEQ ID NO: 646) |
|  | 5'-GCAGCGCAACCACGAGACGGCCUtc-3' | (SEQ ID NO: 17) |
|  | 3'-CACGUCGCGUUGGUGCUCUGCCGGAAG-5' | (SEQ ID NO: 332) |
| MCL1-814 Target: | 5'-GTGCAGCGCAACCACGAGACGGCCTTC-3' | (SEQ ID NO: 647) |
|  | 5'-CAGCGCAACCACGAGACGGCCUUcc-3' | (SEQ ID NO: 18) |
|  | 3'-ACGUCGCGUUGGUGCUCUGCCGGAAGG-5' | (SEQ ID NO: 333) |
| MCL1-815 Target: | 5'-TGCAGCGCAACCACGAGACGGCCTTCC-3' | (SEQ ID NO: 648) |
|  | 5'-AGCGCAACCACGAGACGGCCUUCca-3' | (SEQ ID NO: 19) |
|  | 3'-CGUCGCGUUGGUGCUCUGCCGGAAGGU-5' | (SEQ ID NO: 334) |
| MCL1-816 Target: | 5'-GCAGCGCAACCACGAGACGGCCTTCCA-3' | (SEQ ID NO: 649) |
|  | 5'-GCGCAACCACGAGACGGCCUUCCaa-3' | (SEQ ID NO: 20) |
|  | 3'-GUCGCGUUGGUGCUCUGCCGGAAGGUU-5' | (SEQ ID NO: 335) |
| MCL1-817 Target: | 5'-CAGCGCAACCACGAGACGGCCTTCCAA-3' | (SEQ ID NO: 650) |

TABLE 2-continued

Selected Human Anti-MCL1 DsiRNA Agents (Asymmetrics)

| | | |
|---|---|---|
| MCL1-818 Target: | 5'-CGCAACCACGAGACGGCCUUCCAag-3'<br>3'-UCGCGUUGGUGCUCUGCCGGAAGGUUC-5'<br>5'-AGCGCAACCACGAGACGGCCTTCCAAG-3' | (SEQ ID NO: 21)<br>(SEQ ID NO: 336)<br>(SEQ ID NO: 651) |
| MCL1-819 Target: | 5'-GCAACCACGAGACGGCCUUCCAAgg-3'<br>3'-CGCGUUGGUGCUCUGCCGGAAGGUUCC-5'<br>5'-GCGCAACCACGAGACGGCCTTCCAAGG-3' | (SEQ ID NO: 22)<br>(SEQ ID NO: 337)<br>(SEQ ID NO: 652) |
| MCL1-820 Target: | 5'-CAACCACGAGACGGCCUUCCAAGgc-3'<br>3'-GCGUUGGUGCUCUGCCGGAAGGUUCCG-5'<br>5'-CGCAACCACGAGACGGCCTTCCAAGGC-3' | (SEQ ID NO: 23)<br>(SEQ ID NO: 338)<br>(SEQ ID NO: 653) |
| MCL1-821 Target: | 5'-AACCACGAGACGGCCUUCCAAGGca-3'<br>3'-CGUUGGUGCUCUGCCGGAAGGUUCCGU-5'<br>5'-GCAACCACGAGACGGCCTTCCAAGGCA-3' | (SEQ ID NO: 24)<br>(SEQ ID NO: 339)<br>(SEQ ID NO: 654) |
| MCL1-822 Target: | 5'-ACCACGAGACGGCCUUCCAAGGCat-3'<br>3'-GUUGGUGCUCUGCCGGAAGGUUCCGUA-5'<br>5'-CAACCACGAGACGGCCTTCCAAGGCAT-3' | (SEQ ID NO: 25)<br>(SEQ ID NO: 340)<br>(SEQ ID NO: 655) |
| MCL1-838 Target: | 5'-CCAAGGCAUGCUUCGGAAACUGGac-3'<br>3'-AAGGUUCCGUACGAAGCCUUUGACCUG-5'<br>5'-TTCCAAGGCATGCTTCGGAAACTGGAC-3' | (SEQ ID NO: 26)<br>(SEQ ID NO: 341)<br>(SEQ ID NO: 656) |
| MCL1-839 Target: | 5'-CAAGGCAUGCUUCGGAAACUGGAca-3'<br>3'-AGGUUCCGUACGAAGCCUUUGACCUGU-5'<br>5'-TCCAAGGCATGCTTCGGAAACTGGACA-3' | (SEQ ID NO: 27)<br>(SEQ ID NO: 342)<br>(SEQ ID NO: 657) |
| MCL1-871 Target: | 5'-CGAAGACGAUGUGAAAUCGUUGUct-3'<br>3'-UUGCUUCUGCUACACUUUAGCAACAGA-5'<br>5'-AACGAAGACGATGTGAAATCGTTGTCT-3' | (SEQ ID NO: 28)<br>(SEQ ID NO: 343)<br>(SEQ ID NO: 658) |
| MCL1-877 Target: | 5'-CGAUGUGAAAUCGUUGUCUCGAGtg-3'<br>3'-CUGCUACACUUUAGCAACAGAGCUCAC-5'<br>5'-GACGATGTGAAATCGTTGTCTCGAGTG-3' | (SEQ ID NO: 29)<br>(SEQ ID NO: 344)<br>(SEQ ID NO: 659) |
| MCL1-939 Target: | 5'-GCAGGAUUGUGACUCUCAUUUCUtt-3'<br>3'-CCCGUCCUAACACUGAGAGUAAAGAAA-5'<br>5'-GGGCAGGATTGTGACTCTCATTTCTTT-3' | (SEQ ID NO: 30)<br>(SEQ ID NO: 345)<br>(SEQ ID NO: 660) |
| MCL1-947 Target: | 5'-GUGACUCUCAUUUCUUUUGGUGCct-3'<br>3'-AACACUGAGAGUAAAGAAAACCACGGA-5'<br>5'-TTGTGACTCTCATTTCTTTTGGTGCCT-3' | (SEQ ID NO: 31)<br>(SEQ ID NO: 346)<br>(SEQ ID NO: 661) |
| MCL1-970 Target: | 5'-CUUUGUGGCUAAACACUUGAAGAcc-3'<br>3'-CGGAAACACCGAUUUGUGAACUUCUGG-5'<br>5'-GCCTTTGTGGCTAAACACTTGAAGACC-3' | (SEQ ID NO: 32)<br>(SEQ ID NO: 347)<br>(SEQ ID NO: 662) |
| MCL1-975 Target: | 5'-UGGCUAAACACUUGAAGACCAUAaa-3'<br>3'-ACACCGAUUUGUGAACUUCUGGUAUUU-5'<br>5'-TGTGGCTAAACACTTGAAGACCATAAA-3' | (SEQ ID NO: 33)<br>(SEQ ID NO: 348)<br>(SEQ ID NO: 663) |
| MCL1-976 Target: | 5'-GGCUAAACACUUGAAGACCAUAAac-3'<br>3'-CACCGAUUUGUGAACUUCUGGUAUUUG-5'<br>5'-GTGGCTAAACACTTGAAGACCATAAAC-3' | (SEQ ID NO: 34)<br>(SEQ ID NO: 349)<br>(SEQ ID NO: 664) |
| MCL1-977 Target: | 5'-GCUAAACACUUGAAGACCAUAAAcc-3'<br>3'-ACCGAUUUGUGAACUUCUGGUAUUUGG-5'<br>5'-TGGCTAAACACTTGAAGACCATAAACC-3' | (SEQ ID NO: 35)<br>(SEQ ID NO: 350)<br>(SEQ ID NO: 665) |
| MCL1-978 Target: | 5'-CUAAACACUUGAAGACCAUAAACca-3'<br>3'-CCGAUUUGUGAACUUCUGGUAUUUGGU-5'<br>5'-GGCTAAACACTTGAAGACCATAAACCA-3' | (SEQ ID NO: 36)<br>(SEQ ID NO: 351)<br>(SEQ ID NO: 666) |
| MCL1-984 Target: | 5'-ACUUGAAGACCAUAAACCAAGAAag-3'<br>3'-UGUGAACUUCUGGUAUUUGGUUCUUUC-5'<br>5'-ACACTTGAAGACCATAAACCAAGAAAG-3' | (SEQ ID NO: 37)<br>(SEQ ID NO: 352)<br>(SEQ ID NO: 667) |
| MCL1-985 Target: | 5'-CUUGAAGACCAUAAACCAAGAAAgc-3'<br>3'-GUGAACUUCUGGUAUUUGGUUCUUUCG-5'<br>5'-CACTTGAAGACCATAAACCAAGAAAGC-3' | (SEQ ID NO: 38)<br>(SEQ ID NO: 353)<br>(SEQ ID NO: 668) |
| MCL1-990 Target: | 5'-AGACCAUAAACCAAGAAAGCUGCat-3'<br>3'-CUUCUGGUAUUUGGUUCUUUCGACGUA-5'<br>5'-GAAGACCATAAACCAAGAAAGCTGCAT-3' | (SEQ ID NO: 39)<br>(SEQ ID NO: 354)<br>(SEQ ID NO: 669) |

TABLE 2-continued

Selected Human Anti-MCL1 DsiRNA Agents (Asymmetrics)

| | | |
|---|---|---|
| | 5'-CAUCGAACCAUUAGCAGAAAGUAtc-3' | (SEQ ID NO: 40) |
| | 3'-ACGUAGCUUGGUAAUCGUCUUUCAUAG-5' | (SEQ ID NO: 355) |
| MCL1-1012 Target: | 5'-TGCATCGAACCATTAGCAGAAAGTATC-3' | (SEQ ID NO: 670) |
| | 5'-AUCGAACCAUUAGCAGAAAGUAUca-3' | (SEQ ID NO: 41) |
| | 3'-CGUAGCUUGGUAAUCGUCUUUCAUAGU-5' | (SEQ ID NO: 356) |
| MCL1-1013 Target: | 5'-GCATCGAACCATTAGCAGAAAGTATCA-3' | (SEQ ID NO: 671) |
| | 5'-ACCAUUAGCAGAAAGUAUCACAGac-3' | (SEQ ID NO: 42) |
| | 3'-CUUGGUAAUCGUCUUUCAUAGUGUCUG-5' | (SEQ ID NO: 357) |
| MCL1-1018 Target: | 5'-GAACCATTAGCAGAAAGTATCACAGAC-3' | (SEQ ID NO: 672) |
| | 5'-GGGACUGGCUAGUUAAACAAAGAgg-3' | (SEQ ID NO: 43) |
| | 3'-UGCCCUGACCGAUCAAUUUGUUUCUCC-5' | (SEQ ID NO: 358) |
| MCL1-1062 Target: | 5'-ACGGGACTGGCTAGTTAAACAAAGAGG-3' | (SEQ ID NO: 673) |
| | 5'-GGACUGGCUAGUUAAACAAAGAGgc-3' | (SEQ ID NO: 44) |
| | 3'-GCCCUGACCGAUCAAUUUGUUUCUCCG-5' | (SEQ ID NO: 359) |
| MCL1-1063 Target: | 5'-CGGGACTGGCTAGTTAAACAAAGAGGC-3' | (SEQ ID NO: 674) |
| | 5'-CUAGUUAAACAAAGAGGCUGGGAtg-3' | (SEQ ID NO: 45) |
| | 3'-CCGAUCAAUUUGUUUCUCCGACCCUAC-5' | (SEQ ID NO: 360) |
| MCL1-1070 Target: | 5'-GGCTAGTTAAACAAAGAGGCTGGGATG-3' | (SEQ ID NO: 675) |
| | 5'-AAACAAAGAGGCUGGGAUGGGUUtg-3' | (SEQ ID NO: 46) |
| | 3'-AAUUUGUUUCUCCGACCCUACCCAAAC-5' | (SEQ ID NO: 361) |
| MCL1-1076 Target: | 5'-TTAAACAAAGAGGCTGGGATGGGTTTG-3' | (SEQ ID NO: 676) |
| | 5'-AACAAAGAGGCUGGGAUGGGUUUgt-3' | (SEQ ID NO: 47) |
| | 3'-AUUUGUUUCUCCGACCCUACCCAAACA-5' | (SEQ ID NO: 362) |
| MCL1-1077 Target: | 5'-TAAACAAAGAGGCTGGGATGGGTTTGT-3' | (SEQ ID NO: 677) |
| | 5'-ACAAAGAGGCUGGGAUGGGUUUGtg-3' | (SEQ ID NO: 48) |
| | 3'-UUUGUUUCUCCGACCCUACCCAAACAC-5' | (SEQ ID NO: 363) |
| MCL1-1078 Target: | 5'-AAACAAAGAGGCTGGGATGGGTTTGTG-3' | (SEQ ID NO: 678) |
| | 5'-CAAAGAGGCUGGGAUGGGUUUGUgg-3' | (SEQ ID NO: 49) |
| | 3'-UUGUUUCUCCGACCCUACCCAAACACC-5' | (SEQ ID NO: 364) |
| MCL1-1079 Target: | 5'-AACAAAGAGGCTGGGATGGGTTTGTGG-3' | (SEQ ID NO: 679) |
| | 5'-AAAGAGGCUGGGAUGGGUUUGUGga-3' | (SEQ ID NO: 50) |
| | 3'-UGUUUCUCCGACCCUACCCAAACACCU-5' | (SEQ ID NO: 365) |
| MCL1-1080 Target: | 5'-ACAAAGAGGCTGGGATGGGTTTGTGGA-3' | (SEQ ID NO: 680) |
| | 5'-AAGAGGCUGGGAUGGGUUUGUGGag-3' | (SEQ ID NO: 51) |
| | 3'-GUUUCUCCGACCCUACCCAAACACCUC-5' | (SEQ ID NO: 366) |
| MCL1-1081 Target: | 5'-CAAAGAGGCTGGGATGGGTTTGTGGAG-3' | (SEQ ID NO: 681) |
| | 5'-AGAGGCUGGGAUGGGUUUGUGGAgt-3' | (SEQ ID NO: 52) |
| | 3'-UUUCUCCGACCCUACCCAAACACCUCA-5' | (SEQ ID NO: 367) |
| MCL1-1082 Target: | 5'-AAAGAGGCTGGGATGGGTTTGTGGAGT-3' | (SEQ ID NO: 682) |
| | 5'-GAGGCUGGGAUGGGUUUGUGGAGtt-3' | (SEQ ID NO: 53) |
| | 3'-UUCUCCGACCCUACCCAAACACCUCAA-5' | (SEQ ID NO: 368) |
| MCL1-1083 Target: | 5'-AAGAGGCTGGGATGGGTTTGTGGAGTT-3' | (SEQ ID NO: 683) |
| | 5'-AGGCUGGGAUGGGUUUGUGGAGUtc-3' | (SEQ ID NO: 54) |
| | 3'-UCUCCGACCCUACCCAAACACCUCAAG-5' | (SEQ ID NO: 369) |
| MCL1-1084 Target: | 5'-AGAGGCTGGGATGGGTTTGTGGAGTTC-3' | (SEQ ID NO: 684) |
| | 5'-GGCUGGGAUGGGUUUGUGGAGUUct-3' | (SEQ ID NO: 55) |
| | 3'-CUCCGACCCUACCCAAACACCUCAAGA-5' | (SEQ ID NO: 370) |
| MCL1-1085 Target: | 5'-GAGGCTGGGATGGGTTTGTGGAGTTCT-3' | (SEQ ID NO: 685) |
| | 5'-GCUGGGAUGGGUUUGUGGAGUUCtt-3' | (SEQ ID NO: 56) |
| | 3'-UCCGACCCUACCCAAACACCUCAAGAA-5' | (SEQ ID NO: 371) |
| MCL1-1086 Target: | 5'-AGGCTGGGATGGGTTTGTGGAGTTCTT-3' | (SEQ ID NO: 686) |
| | 5'-CUGGGAUGGGUUUGUGGAGUUCUtc-3' | (SEQ ID NO: 57) |
| | 3'-CCGACCCUACCCAAACACCUCAAGAAG-5' | (SEQ ID NO: 372) |
| MCL1-1087 Target: | 5'-GGCTGGGATGGGTTTGTGGAGTTCTTC-3' | (SEQ ID NO: 687) |
| | 5'-UGGGAUGGGUUUGUGGAGUUCUUcc-3' | (SEQ ID NO: 58) |
| | 3'-CGACCCUACCCAAACACCUCAAGAAGG-5' | (SEQ ID NO: 373) |
| MCL1-1088 Target: | 5'-GCTGGGATGGGTTTGTGGAGTTCTTCC-3' | (SEQ ID NO: 688) |

TABLE 2-continued

Selected Human Anti-MCL1 DsiRNA Agents (Asymmetrics)

| | | |
|---|---|---|
| | 5'-GGGAUGGGUUUGUGGAGUUCUUCca-3' | (SEQ ID NO: 59) |
| | 3'-GACCCUACCCAAACACCUCAAGAAGGU-5' | (SEQ ID NO: 374) |
| MCL1-1089 Target: | 5'-CTGGGATGGGTTTGTGGAGTTCTTCCA-3' | (SEQ ID NO: 689) |
| | 5'-GGAUGGGUUUGUGGAGUUCUUCCat-3' | (SEQ ID NO: 60) |
| | 3'-ACCCUACCCAAACACCUCAAGAAGGUA-5' | (SEQ ID NO: 375) |
| MCL1-1090 Target: | 5'-TGGGATGGGTTTGTGGAGTTCTTCCAT-3' | (SEQ ID NO: 690) |
| | 5'-GAUGGGUUUGUGGAGUUCUUCCAtg-3' | (SEQ ID NO: 61) |
| | 3'-CCCUACCCAAACACCUCAAGAAGGUAC-5' | (SEQ ID NO: 376) |
| MCL1-1091 Target: | 5'-GGGATGGGTTTGTGGAGTTCTTCCATG-3' | (SEQ ID NO: 691) |
| | 5'-AUGGGUUUGUGGAGUUCUUCCAUgt-3' | (SEQ ID NO: 62) |
| | 3'-CCUACCCAAACACCUCAAGAAGGUACA-5' | (SEQ ID NO: 377) |
| MCL1-1092 Target: | 5'-GGATGGGTTTGTGGAGTTCTTCCATGT-3' | (SEQ ID NO: 692) |
| | 5'-UGGGUUUGUGGAGUUCUUCCAUGta-3' | (SEQ ID NO: 63) |
| | 3'-CUACCCAAACACCUCAAGAAGGUACAU-5' | (SEQ ID NO: 378) |
| MCL1-1093 Target: | 5'-GATGGGTTTGTGGAGTTCTTCCATGTA-3' | (SEQ ID NO: 693) |
| | 5'-GGGUUUGUGGAGUUCUUCCAUGUag-3' | (SEQ ID NO: 64) |
| | 3'-UACCCAAACACCUCAAGAAGGUACAUC-5' | (SEQ ID NO: 379) |
| MCL1-1094 Target: | 5'-ATGGGTTTGTGGAGTTCTTCCATGTAG-3' | (SEQ ID NO: 694) |
| | 5'-GGUUUGUGGAGUUCUUCCAUGUAga-3' | (SEQ ID NO: 65) |
| | 3'-ACCCAAACACCUCAAGAAGGUACAUCU-5' | (SEQ ID NO: 380) |
| MCL1-1095 Target: | 5'-TGGGTTTGTGGAGTTCTTCCATGTAGA-3' | (SEQ ID NO: 695) |
| | 5'-AGUUCUUCCAUGUAGAGGACCUAga-3' | (SEQ ID NO: 66) |
| | 3'-CCUCAAGAAGGUACAUCUCCUGGAUCU-5' | (SEQ ID NO: 381) |
| MCL1-1104 Target: | 5'-GGAGTTCTTCCATGTAGAGGACCTAGA-3' | (SEQ ID NO: 696) |
| | 5'-CCAUGUAGAGGACCUAGAAGGUGgc-3' | (SEQ ID NO: 67) |
| | 3'-AAGGUACAUCUCCUGGAUCUUCCACCG-5' | (SEQ ID NO: 382) |
| MCL1-1111 Target: | 5'-TTCCATGTAGAGGACCTAGAAGGTGGC-3' | (SEQ ID NO: 697) |
| | 5'-GGACCUAGAAGGUGGCAUCAGGAat-3' | (SEQ ID NO: 68) |
| | 3'-CUCCUGGAUCUUCCACCGUAGUCCUUA-5' | (SEQ ID NO: 383) |
| MCL1-1120 Target: | 5'-GAGGACCTAGAAGGTGGCATCAGGAAT-3' | (SEQ ID NO: 698) |
| | 5'-GGUGUUGCUGGAGUAGGAGCUGGtt-3' | (SEQ ID NO: 69) |
| | 3'-GUCCACAACGACCUCAUCCUCGACCAA-5' | (SEQ ID NO: 384) |
| MCL1-1163 Target: | 5'-CAGGTGTTGCTGGAGTAGGAGCTGGTT-3' | (SEQ ID NO: 699) |
| | 5'-CUGGUUUGGCAUAUCUAAUAAGAta-3' | (SEQ ID NO: 70) |
| | 3'-UCGACCAAACCGUAUAGAUUAUUCUAU-5' | (SEQ ID NO: 385) |
| MCL1-1182 Target: | 5'-AGCTGGTTTGGCATATCTAATAAGATA-3' | (SEQ ID NO: 700) |
| | 5'-UGGCAUAUCUAAUAAGAUAGCCUta-3' | (SEQ ID NO: 71) |
| | 3'-AAACCGUAUAGAUUAUUCUAUCGGAAU-5' | (SEQ ID NO: 386) |
| MCL1-1188 Target: | 5'-TTTGGCATATCTAATAAGATAGCCTTA-3' | (SEQ ID NO: 701) |
| | 5'-GGCAUAUCUAAUAAGAUAGCCUUac-3' | (SEQ ID NO: 72) |
| | 3'-AACCGUAUAGAUUAUUCUAUCGGAAUG-5' | (SEQ ID NO: 387) |
| MCL1-1189 Target: | 5'-TTGGCATATCTAATAAGATAGCCTTAC-3' | (SEQ ID NO: 702) |
| | 5'-GCAUAUCUAAUAAGAUAGCCUUAct-3' | (SEQ ID NO: 73) |
| | 3'-ACCGUAUAGAUUAUUCUAUCGGAAUGA-5' | (SEQ ID NO: 388) |
| MCL1-1190 Target: | 5'-TGGCATATCTAATAAGATAGCCTTACT-3' | (SEQ ID NO: 703) |
| | 5'-CAUAUCUAAUAAGAUAGCCUUACtg-3' | (SEQ ID NO: 74) |
| | 3'-CCGUAUAGAUUAUUCUAUCGGAAUGAC-5' | (SEQ ID NO: 389) |
| MCL1-1191 Target: | 5'-GGCATATCTAATAAGATAGCCTTACTG-3' | (SEQ ID NO: 704) |
| | 5'-AUAUCUAAUAAGAUAGCCUUACUgt-3' | (SEQ ID NO: 75) |
| | 3'-CGUAUAGAUUAUUCUAUCGGAAUGACA-5' | (SEQ ID NO: 390) |
| MCL1-1192 Target: | 5'-GCATATCTAATAAGATAGCCTTACTGT-3' | (SEQ ID NO: 705) |
| | 5'-UAUCUAAUAAGAUAGCCUUACUGta-3' | (SEQ ID NO: 76) |
| | 3'-GUAUAGAUUAUUCUAUCGGAAUGACAU-5' | (SEQ ID NO: 391) |
| MCL1-1193 Target: | 5'-CATATCTAATAAGATAGCCTTACTGTA-3' | (SEQ ID NO: 706) |
| | 5'-GCCUUACUGUAAGUGCAAUAGUUga-3' | (SEQ ID NO: 77) |
| | 3'-AUCGGAAUGACAUUCACGUUAUCAACU-5' | (SEQ ID NO: 392) |
| MCL1-1207 Target: | 5'-TAGCCTTACTGTAAGTGCAATAGTTGA-3' | (SEQ ID NO: 707) |

TABLE 2-continued

Selected Human Anti-MCL1 DsiRNA Agents (Asymmetrics)

| | | |
|---|---|---|
| MCL1-1276 | 5'-GGACUCCAAGCUGUAACUUCCUAga-3'<br>3'-AACCUGAGGUUCGACAUUGAAGGAUCU-5'<br>Target: 5'-TTGGACTCCAAGCTGTAACTTCCTAGA-3' | (SEQ ID NO: 78)<br>(SEQ ID NO: 393)<br>(SEQ ID NO: 708) |
| MCL1-1293 | 5'-UUCCUAGAGUUGCACCCUAGCAAcc-3'<br>3'-UGAAGGAUCUCAACGUGGGAUCGUUGG-5'<br>Target: 5'-ACTTCCTAGAGTTGCACCCTAGCAACC-3' | (SEQ ID NO: 79)<br>(SEQ ID NO: 394)<br>(SEQ ID NO: 709) |
| MCL1-1329 | 5'-GCAAGUGGCAAGAGGAUUAUGGCta-3'<br>3'-UUCGUUCACCGUUCUCCUAAUACCGAU-5'<br>Target: 5'-AAGCAAGTGGCAAGAGGATTATGGCTA-3' | (SEQ ID NO: 80)<br>(SEQ ID NO: 395)<br>(SEQ ID NO: 710) |
| MCL1-1334 | 5'-UGGCAAGAGGAUUAUGGCUAACAag-3'<br>3'-UCACCGUUCUCCUAAUACCGAUUGUUC-5'<br>Target: 5'-AGTGGCAAGAGGATTATGGCTAACAAG-3' | (SEQ ID NO: 81)<br>(SEQ ID NO: 396)<br>(SEQ ID NO: 711) |
| MCL1-1335 | 5'-GGCAAGAGGAUUAUGGCUAACAga-3'<br>3'-CACCGUUCUCCUAAUACCGAUUGUUCU-5'<br>Target: 5'-GTGGCAAGAGGATTATGGCTAACAAGA-3' | (SEQ ID NO: 82)<br>(SEQ ID NO: 397)<br>(SEQ ID NO: 712) |
| MCL1-1340 | 5'-GAGGAUUAUGGCUAACAAGAAUAaa-3'<br>3'-UUCUCCUAAUACCGAUUGUUCUUAUUU-5'<br>Target: 5'-AAGAGGATTATGGCTAACAAGAATAAA-3' | (SEQ ID NO: 83)<br>(SEQ ID NO: 398)<br>(SEQ ID NO: 713) |
| MCL1-1348 | 5'-UGGCUAACAAGAAUAAAUACAUGgg-3'<br>3'-AUACCGAUUGUUCUUAUUUAUGUACCC-5'<br>Target: 5'-TATGGCTAACAAGAATAAATACATGGG-3' | (SEQ ID NO: 84)<br>(SEQ ID NO: 399)<br>(SEQ ID NO: 714) |
| MCL1-1349 | 5'-GGCUAACAAGAAUAAAUACAUGGga-3'<br>3'-UACCGAUUGUUCUUAUUUAUGUACCCU-5'<br>Target: 5'-ATGGCTAACAAGAATAAATACATGGGA-3' | (SEQ ID NO: 85)<br>(SEQ ID NO: 400)<br>(SEQ ID NO: 715) |
| MCL1-1350 | 5'-GCUAACAAGAAUAAAUACAUGGGaa-3'<br>3'-ACCGAUUGUUCUUAUUUAUGUACCCUU-5'<br>Target: 5'-TGGCTAACAAGAATAAATACATGGGAA-3' | (SEQ ID NO: 86)<br>(SEQ ID NO: 401)<br>(SEQ ID NO: 716) |
| MCL1-1351 | 5'-CUAACAAGAAUAAAUACAUGGGAag-3'<br>3'-CCGAUUGUUCUUAUUUAUGUACCCUUC-5'<br>Target: 5'-GGCTAACAAGAATAAATACATGGGAAG-3' | (SEQ ID NO: 87)<br>(SEQ ID NO: 402)<br>(SEQ ID NO: 717) |
| MCL1-1352 | 5'-UAACAAGAAUAAAUACAUGGGAAga-3'<br>3'-CGAUUGUUCUUAUUUAUGUACCCUUCU-5'<br>Target: 5'-GCTAACAAGAATAAATACATGGGAAGA-3' | (SEQ ID NO: 88)<br>(SEQ ID NO: 403)<br>(SEQ ID NO: 718) |
| MCL1-1353 | 5'-AACAAGAAUAAAUACAUGGGAAGag-3'<br>3'-GAUUGUUCUUAUUUAUGUACCCUUCUC-5'<br>Target: 5'-CTAACAAGAATAAATACATGGGAAGAG-3' | (SEQ ID NO: 89)<br>(SEQ ID NO: 404)<br>(SEQ ID NO: 719) |
| MCL1-1354 | 5'-ACAAGAAUAAAUACAUGGGAAGAgt-3'<br>3'-AUUGUUCUUAUUUAUGUACCCUUCUCA-5'<br>Target: 5'-TAACAAGAATAAATACATGGGAAGAGT-3' | (SEQ ID NO: 90)<br>(SEQ ID NO: 405)<br>(SEQ ID NO: 720) |
| MCL1-1355 | 5'-CAAGAAUAAAUACAUGGGAAGAGtg-3'<br>3'-UUGUUCUUAUUUAUGUACCCUUCUCAC-5'<br>Target: 5'-AACAAGAATAAATACATGGGAAGAGTG-3' | (SEQ ID NO: 91)<br>(SEQ ID NO: 406)<br>(SEQ ID NO: 721) |
| MCL1-1356 | 5'-AAGAAUAAAUACAUGGGAAGAGUgc-3'<br>3'-UGUUCUUAUUUAUGUACCCUUCUCACG-5'<br>Target: 5'-ACAAGAATAAATACATGGGAAGAGTGC-3' | (SEQ ID NO: 92)<br>(SEQ ID NO: 407)<br>(SEQ ID NO: 722) |
| MCL1-1357 | 5'-AGAAUAAAUACAUGGGAAGAGUGct-3'<br>3'-GUUCUUAUUUAUGUACCCUUCUCACGA-5'<br>Target: 5'-CAAGAATAAATACATGGGAAGAGTGCT-3' | (SEQ ID NO: 93)<br>(SEQ ID NO: 408)<br>(SEQ ID NO: 723) |
| MCL1-1385 | 5'-CAUUGAUUGAAGAGUCACUGUCUga-3'<br>3'-GGGUAACUAACUUCUCAGUGACAGACU-5'<br>Target: 5'-CCCATTGATTGAAGAGTCACTGTCTGA-3' | (SEQ ID NO: 94)<br>(SEQ ID NO: 409)<br>(SEQ ID NO: 724) |
| MCL1-1402 | 5'-CUGUCUGAAAGAAGCAAAGUUCAgt-3'<br>3'-GUGACAGACUUUCUUCGUUUCAAGUCA-5'<br>Target: 5'-CACTGTCTGAAAGAAGCAAAGTTCAGT-3' | (SEQ ID NO: 95)<br>(SEQ ID NO: 410)<br>(SEQ ID NO: 725) |
| MCL1-1438 | 5'-ACAAACUUUGUUUGGGAAGCUAUgg-3'<br>3'-UUUGUUUGAAACAAACCCUUCGAUACC-5'<br>Target: 5'-AAACAAACTTTGTTTGGGAAGCTATGG-3' | (SEQ ID NO: 96)<br>(SEQ ID NO: 411)<br>(SEQ ID NO: 726) |

TABLE 2-continued

Selected Human Anti-MCL1 DsiRNA Agents (Asymmetrics)

|  |  |  |
|---|---|---|
|  | 5'-AGGACUUUUAGAUUUAGUGAAGAtg-3' | (SEQ ID NO: 97) |
|  | 3'-CCUCCUGAAAAUCUAAAUCACUUCUAC-5' | (SEQ ID NO: 412) |
| MCL1-1466 Target: | 5'-GGAGGACTTTTAGATTTAGTGAAGATG-3' | (SEQ ID NO: 727) |
|  | 5'-AGAUGGUAGGGUGGAAAGACUUAat-3' | (SEQ ID NO: 98) |
|  | 3'-CUUCUACCAUCCCACCUUUCUGAAUUA-5' | (SEQ ID NO: 413) |
| MCL1-1486 Target: | 5'-GAAGATGGTAGGGTGGAAAGACTTAAT-3' | (SEQ ID NO: 728) |
|  | 5'-CUUGUUGAGAACAGGAAAGUGGCca-3' | (SEQ ID NO: 99) |
|  | 3'-AGGAACAACUCUUGUCCUUUCACCGGU-5' | (SEQ ID NO: 414) |
| MCL1-1514 Target: | 5'-TCCTTGTTGAGAACAGGAAAGTGGCCA-3' | (SEQ ID NO: 729) |
|  | 5'-GCCAGGCAAGUCAUAGAAUUGAUta-3' | (SEQ ID NO: 100) |
|  | 3'-AUCGGUCCGUUCAGUAUCUUAACUAAU-5' | (SEQ ID NO: 415) |
| MCL1-1542 Target: | 5'-TAGCCAGGCAAGTCATAGAATTGATTA-3' | (SEQ ID NO: 730) |
|  | 5'-AGGCAAGUCAUAGAAUUGAUUACcc-3' | (SEQ ID NO: 101) |
|  | 3'-GGUCCGUUCAGUAUCUUAACUAAUGGG-5' | (SEQ ID NO: 416) |
| MCL1-1545 Target: | 5'-CCAGGCAAGTCATAGAATTGATTACCC-3' | (SEQ ID NO: 731) |
|  | 5'-GGCAAGUCAUAGAAUUGAUUACCcg-3' | (SEQ ID NO: 102) |
|  | 3'-GUCCGUUCAGUAUCUUAACUAAUGGGC-5' | (SEQ ID NO: 417) |
| MCL1-1546 Target: | 5'-CAGGCAAGTCATAGAATTGATTACCCG-3' | (SEQ ID NO: 732) |
|  | 5'-CCCGCCGAAUUCAUUAAUUUACUgt-3' | (SEQ ID NO: 103) |
|  | 3'-AUGGGCGGCUUAAGUAAUUAAAUGACA-5' | (SEQ ID NO: 418) |
| MCL1-1567 Target: | 5'-TACCCGCCGAATTCATTAATTTACTGT-3' | (SEQ ID NO: 733) |
|  | 5'-CGAAUUCAUUAAUUUACUGUAGUgt-3' | (SEQ ID NO: 104) |
|  | 3'-CGGCUUAAGUAAUUAAAUGACAUCACA-5' | (SEQ ID NO: 419) |
| MCL1-1572 Target: | 5'-GCCGAATTCATTAATTTACTGTAGTGT-3' | (SEQ ID NO: 734) |
|  | 5'-GUGUUAAGAGAAGCACUAAGAAUgc-3' | (SEQ ID NO: 105) |
|  | 3'-AUCACAAUUCUCUUCGUGAUUCUUACG-5' | (SEQ ID NO: 420) |
| MCL1-1593 Target: | 5'-TAGTGTTAAGAGAAGCACTAAGAATGC-3' | (SEQ ID NO: 735) |
|  | 5'-AGCACUAAGAAUGCCAGUGACCUgt-3' | (SEQ ID NO: 106) |
|  | 3'-CUUCGUGAUUCUUACGGUCACUGGACA-5' | (SEQ ID NO: 421) |
| MCL1-1604 Target: | 5'-GAAGCACTAAGAATGCCAGTGACCTGT-3' | (SEQ ID NO: 736) |
|  | 5'-AAGUAAUAGAACUAUGACUGUAAgc-3' | (SEQ ID NO: 107) |
|  | 3'-UGUUCAUUAUCUUGAUACUGACAUUCG-5' | (SEQ ID NO: 422) |
| MCL1-1640 Target: | 5'-ACAAGTAATAGAACTATGACTGTAAGC-3' | (SEQ ID NO: 737) |
|  | 5'-GUAAUAGAACUAUGACUGUAAGCct-3' | (SEQ ID NO: 108) |
|  | 3'-UUCAUUAUCUUGAUACUGACAUUCGGA-5' | (SEQ ID NO: 423) |
| MCL1-1642 Target: | 5'-AAGTAATAGAACTATGACTGTAAGCCT-3' | (SEQ ID NO: 738) |
|  | 5'-CUCAGUACUGUACAAGGGAAGCUtt-3' | (SEQ ID NO: 109) |
|  | 3'-CGGAGUCAUGACAUGUUCCCUUCGAAA-5' | (SEQ ID NO: 424) |
| MCL1-1665 Target: | 5'-GCCTCAGTACTGTACAAGGGAAGCTTT-3' | (SEQ ID NO: 739) |
|  | 5'-CCAGUAUACUUCUUAGAAAGUCCaa-3' | (SEQ ID NO: 110) |
|  | 3'-AGGGUCAUAUGAAGAAUCUUUCAGGUU-5' | (SEQ ID NO: 425) |
| MCL1-1711 Target: | 5'-TCCCAGTATACTTCTTAGAAAGTCCAA-3' | (SEQ ID NO: 740) |
|  | 5'-CCUGUUAUACUUUGGCUUGGUUUcc-3' | (SEQ ID NO: 111) |
|  | 3'-AUGGACAAUAUGAAACCGAACCAAAGG-5' | (SEQ ID NO: 426) |
| MCL1-1754 Target: | 5'-TACCTGTTATACTTTGGCTTGGTTTCC-3' | (SEQ ID NO: 741) |
|  | 5'-CCUAGUUUAUCACCAAUAAUACUtg-3' | (SEQ ID NO: 112) |
|  | 3'-UCGGAUCAAAUAGUGGUUAUUAUGAAC-5' | (SEQ ID NO: 427) |
| MCL1-1798 Target: | 5'-AGCCTAGTTTATCACCAATAATACTTG-3' | (SEQ ID NO: 742) |
|  | 5'-CACCAAUAAUACUUGACGGAAGGct-3' | (SEQ ID NO: 113) |
|  | 3'-UAGUGGUUAUUAUGAACUGCCUUCCGA-5' | (SEQ ID NO: 428) |
| MCL1-1808 Target: | 5'-ATCACCAATAATACTTGACGGAAGGCT-3' | (SEQ ID NO: 743) |
|  | 5'-ACCAAUAAUACUUGACGGAAGGCtc-3' | (SEQ ID NO: 114) |
|  | 3'-AGUGGUUAUUAUGAACUGCCUUCCGAG-5' | (SEQ ID NO: 429) |
| MCL1-1809 Target: | 5'-TCACCAATAATACTTGACGGAAGGCTC-3' | (SEQ ID NO: 744) |
|  | 5'-CCAAUAAUACUUGACGGAAGGCUca-3' | (SEQ ID NO: 115) |
|  | 3'-GUGGUUAUUAUGAACUGCCUUCCGAGU-5' | (SEQ ID NO: 430) |
| MCL1-1810 Target: | 5'-CACCAATAATACTTGACGGAAGGCTCA-3' | (SEQ ID NO: 745) |

TABLE 2-continued

Selected Human Anti-MCL1 DsiRNA Agents (Asymmetrics)

| | | |
|---|---|---|
| | 5'-GGCUCAGUAAUUAGUUAUGAAUAtg-3' | (SEQ ID NO: 116) |
| | 3'-UUCCGAGUCAUUAAUCAAUACUUAUAC-5' | (SEQ ID NO: 431) |
| MCL1-1829 Target: | 5'-AAGGCTCAGTAATTAGTTATGAATATG-3' | (SEQ ID NO: 746) |
| | 5'-CAGUAAUUAGUUAUGAAUAUGGAta-3' | (SEQ ID NO: 117) |
| | 3'-GAGUCAUUAAUCAAUACUUAUACCUAU-5' | (SEQ ID NO: 432) |
| MCL1-1833 Target: | 5'-CTCAGTAATTAGTTATGAATATGGATA-3' | (SEQ ID NO: 747) |
| | 5'-UCUUAAGACAGCUUGUAAAUGUAtt-3' | (SEQ ID NO: 118) |
| | 3'-UAAGAAUUCUGUCGAACAUUUACAUAA-5' | (SEQ ID NO: 433) |
| MCL1-1866 Target: | 5'-ATTCTTAAGACAGCTTGTAAATGTATT-3' | (SEQ ID NO: 748) |
| | 5'-UAAAAAUUGUAUAUAUUUUUACAga-3' | (SEQ ID NO: 119) |
| | 3'-ACAUUUUUAACAUAUAUAAAAAUGUCU-5' | (SEQ ID NO: 434) |
| MCL1-1893 Target: | 5'-TGTAAAAATTGTATATATTTTTACAGA-3' | (SEQ ID NO: 749) |
| | 5'-UACAGAAAGUCUAUUUCUUUGAAac-3' | (SEQ ID NO: 120) |
| | 3'-AAAUGUCUUUCAGAUAAAGAAACUUUG-5' | (SEQ ID NO: 435) |
| MCL1-1912 Target: | 5'-TTTACAGAAAGTCTATTTCTTTGAAAC-3' | (SEQ ID NO: 750) |
| | 5'-ACAGAAAGUCUAUUUCUUUGAAAcg-3' | (SEQ ID NO: 121) |
| | 3'-AAUGUCUUUCAGAUAAAGAAACUUUGC-5' | (SEQ ID NO: 436) |
| MCL1-1913 Target: | 5'-TTACAGAAAGTCTATTTCTTTGAAACG-3' | (SEQ ID NO: 751) |
| | 5'-CAGAAAGUCUAUUUCUUUGAAACga-3' | (SEQ ID NO: 122) |
| | 3'-AUGUCUUUCAGAUAAAGAAACUUUGCU-5' | (SEQ ID NO: 437) |
| MCL1-1914 Target: | 5'-TACAGAAAGTCTATTTCTTTGAAACGA-3' | (SEQ ID NO: 752) |
| | 5'-AGAAAGUCUAUUUCUUUGAAACGaa-3' | (SEQ ID NO: 123) |
| | 3'-UGUCUUUCAGAUAAAGAAACUUUGCUU-5' | (SEQ ID NO: 438) |
| MCL1-1915 Target: | 5'-ACAGAAAGTCTATTTCTTTGAAACGAA-3' | (SEQ ID NO: 753) |
| | 5'-GAAAGUCUAUUUCUUUGAAACGAag-3' | (SEQ ID NO: 124) |
| | 3'-GUCUUUCAGAUAAAGAAACUUUGCUUC-5' | (SEQ ID NO: 439) |
| MCL1-1916 Target: | 5'-CAGAAAGTCTATTTCTTTGAAACGAAG-3' | (SEQ ID NO: 754) |
| | 5'-CGAAGGAAGUAUCGAAUUUACAUta-3' | (SEQ ID NO: 125) |
| | 3'-UUGCUUCCUUCAUAGCUUAAAUGUAAU-5' | (SEQ ID NO: 440) |
| MCL1-1936 Target: | 5'-AACGAAGGAAGTATCGAATTTACATTA-3' | (SEQ ID NO: 755) |
| | 5'-CGAAUUUACAUUAGUUUUUUUCAta-3' | (SEQ ID NO: 126) |
| | 3'-UAGCUUAAAUGUAAUCAAAAAAAGUAU-5' | (SEQ ID NO: 441) |
| MCL1-1948 Target: | 5'-ATCGAATTTACATTAGTTTTTTTCATA-3' | (SEQ ID NO: 756) |
| | 5'-ACUUUGCAACUUCCGUAAUUAGGaa-3' | (SEQ ID NO: 127) |
| | 3'-CUUGAAACGUUGAAGGCAUUAAUCCUU-5' | (SEQ ID NO: 442) |
| MCL1-1982 Target: | 5'-GAACTTTGCAACTTCCGTAATTAGGAA-3' | (SEQ ID NO: 757) |
| | 5'-AGUGUAUACAGAACGAAUUGAUGtg-3' | (SEQ ID NO: 128) |
| | 3'-UCUCACAUAUGUCUUGCUUAACUACAC-5' | (SEQ ID NO: 443) |
| MCL1-2057 Target: | 5'-AGAGTGTATACAGAACGAATTGATGTG-3' | (SEQ ID NO: 758) |
| | 5'-GGAACAAAUCUGAUAACUAUGCAgg-3' | (SEQ ID NO: 129) |
| | 3'-CACCUUGUUUAGACUAUUGAUACGUCC-5' | (SEQ ID NO: 444) |
| MCL1-2107 Target: | 5'-GTGGAACAAATCTGATAACTATGCAGG-3' | (SEQ ID NO: 759) |
| | 5'-AUUUUCUUAUCUGAUUUUGGUAAgt-3' | (SEQ ID NO: 130) |
| | 3'-UUUAAAAGAAUAGACUAAAACCAUUCA-5' | (SEQ ID NO: 445) |
| MCL1-2137 Target: | 5'-AAATTTTCTTATCTGATTTTGGTAAGT-3' | (SEQ ID NO: 760) |
| | 5'-GGUUUUCUUUGAAAACCUGGGAtt-3' | (SEQ ID NO: 131) |
| | 3'-AUCCAAAAGAAACUUUUGGACCCUAA-5' | (SEQ ID NO: 446) |
| MCL1-2174 Target: | 5'-TAGGTTTTCTTTGAAAACCTGGGATT-3' | (SEQ ID NO: 761) |
| | 5'-GGGAUUGAGAGGUUGAUGAAUGGaa-3' | (SEQ ID NO: 132) |
| | 3'-GACCCUAACUCUCCAACUACUUACCUU-5' | (SEQ ID NO: 447) |
| MCL1-2193 Target: | 5'-CTGGGATTGAGAGGTTGATGAATGGAA-3' | (SEQ ID NO: 762) |
| | 5'-AGAGGUUGAUGAAUGGAAAUUCUtt-3' | (SEQ ID NO: 133) |
| | 3'-ACUCUCCAACUACUUACCUUUAAGAAA-5' | (SEQ ID NO: 448) |
| MCL1-2200 Target: | 5'-TGAGAGGTTGATGAATGGAAATTCTTT-3' | (SEQ ID NO: 763) |
| | 5'-GUUGAUGAAUGGAAAUUCUUUCAct-3' | (SEQ ID NO: 134) |
| | 3'-UCCAACUACUUACCUUUAAGAAAGUGA-5' | (SEQ ID NO: 449) |
| MCL1-2204 Target: | 5'-AGGTTGATGAATGGAAATTCTTTCACT-3' | (SEQ ID NO: 764) |

TABLE 2-continued

Selected Human Anti-MCL1 DsiRNA Agents (Asymmetrics)

|  |  |  |
| --- | --- | --- |
| MCL1-2235 Target: | 5'-UAUGCAAGUUUUCAAUAAUUAGGtc-3'<br>3'-AUAUACGUUCAAAAGUUAUUAAUCCAG-5'<br>5'-TATATGCAAGTTTTCAATAATTAGGTC-3' | (SEQ ID NO: 135)<br>(SEQ ID NO: 450)<br>(SEQ ID NO: 765) |
| MCL1-2275 Target: | 5'-GGUUACUGAUGACUUACAAAUAAtg-3'<br>3'-UUCCAAUGACUACUGAAUGUUUAUUAC-5'<br>5'-AAGGTTACTGATGACTTACAAATAATG-3' | (SEQ ID NO: 136)<br>(SEQ ID NO: 451)<br>(SEQ ID NO: 766) |
| MCL1-2309 Target: | 5'-UGGGCAAUACUCAUUUGAGUUCCtt-3'<br>3'-UAACCCGUUAUGAGUAAACUCAAGGAA-5'<br>5'-ATTGGGCAATACTCATTTGAGTTCCTT-3' | (SEQ ID NO: 137)<br>(SEQ ID NO: 452)<br>(SEQ ID NO: 767) |
| MCL1-2334 Target: | 5'-CCAUUUGACCUAAUUUAACUGGUga-3'<br>3'-AAGGUAAACUGGAUUAAAUUGACCACU-5'<br>5'-TTCCATTTGACCTAATTTAACTGGTGA-3' | (SEQ ID NO: 138)<br>(SEQ ID NO: 453)<br>(SEQ ID NO: 768) |
| MCL1-2389 Target: | 5'-AAAGCUUUUACUAAAAGAUUUUCag-3'<br>3'-AAUUUCGAAAAUGAUUUUCUAAAAGUC-5'<br>5'-TTAAAGCTTTTACTAAAAGATTTTCAG-3' | (SEQ ID NO: 139)<br>(SEQ ID NO: 454)<br>(SEQ ID NO: 769) |
| MCL1-2459 Target: | 5'-GGUGGAUGGAGAGACAUUUGAUCcc-3'<br>3'-GUCCACCUACCUCUCUGUAAACUAGGG-5'<br>5'-CAGGTGGATGGAGAGACATTTGATCCC-3' | (SEQ ID NO: 140)<br>(SEQ ID NO: 455)<br>(SEQ ID NO: 770) |
| MCL1-2491 Target: | 5'-CUUAAUAAAUUAUAAAAUGAUGGct-3'<br>3'-ACGAAUUAUUUAAUAUUUUACUACCGA-5'<br>5'-TGCTTAATAAATTATAAAATGATGGCT-3' | (SEQ ID NO: 141)<br>(SEQ ID NO: 456)<br>(SEQ ID NO: 771) |
| MCL1-2536 Target: | 5'-ACCAUGGUGCUAUUAUUAGGCUUgc-3'<br>3'-AUUGGUACCACGAUAAUAAUCCGAACG-5'<br>5'-TAACCATGGTGCTATTATTAGGCTTGC-3' | (SEQ ID NO: 142)<br>(SEQ ID NO: 457)<br>(SEQ ID NO: 772) |
| MCL1-2581 Target: | 5'-AGCCUAGUAUGUCAAUAAAGCAAat-3'<br>3'-AUUCGGAUCAUACAGUUAUUUCGUUUA-5'<br>5'-TAAGCCTAGTATGTCAATAAAGCAAAT-3' | (SEQ ID NO: 143)<br>(SEQ ID NO: 458)<br>(SEQ ID NO: 773) |
| MCL1-2611 Target: | 5'-CUGUUUUGUUUCUAUUAAUGAUUcc-3'<br>3'-AUGACAAAACAAAGAUAAUUACUAAGG-5'<br>5'-TACTGTTTTGTTTCTATTAATGATTCC-3' | (SEQ ID NO: 144)<br>(SEQ ID NO: 459)<br>(SEQ ID NO: 774) |
| MCL1-2622 Target: | 5'-CUAUUAAUGAUUCCCAAACCUUGtt-3'<br>3'-AAGAUAAUUACUAAGGGUUUGGAACAA-5'<br>5'-TTCTATTAATGATTCCCAAACCTTGTT-3' | (SEQ ID NO: 145)<br>(SEQ ID NO: 460)<br>(SEQ ID NO: 775) |
| MCL1-2643 Target: | 5'-UGUUGCAAGUUUUUGCAUUGGCAtc-3'<br>3'-GAACAACGUUCAAAAACGUAACCGUAG-5'<br>5'-CTTGTTGCAAGTTTTTGCATTGGCATC-3' | (SEQ ID NO: 146)<br>(SEQ ID NO: 461)<br>(SEQ ID NO: 776) |
| MCL1-2671 Target: | 5'-GGAUUUCAGUCUUGAUGUUUGUUct-3'<br>3'-AACCUAAAGUCAGAACUACAAACAAGA-5'<br>5'-TTGGATTTCAGTCTTGATGTTTGTTCT-3' | (SEQ ID NO: 147)<br>(SEQ ID NO: 462)<br>(SEQ ID NO: 777) |
| MCL1-2725 Target: | 5'-UCCUUGAAAUUGCUGAUUGUUCUgc-3'<br>3'-GAAGGAACUUUAACGACUAACAAGACG-5'<br>5'-CTTCCTTGAAATTGCTGATTGTTCTGC-3' | (SEQ ID NO: 148)<br>(SEQ ID NO: 463)<br>(SEQ ID NO: 778) |
| MCL1-2750 Target: | 5'-UCCCUCUACAGAUAUUUAUAUCAat-3'<br>3'-CGAGGGAGAUGUCUAUAAAUAUAGUUA-5'<br>5'-GCTCCCTCTACAGATATTTATATCAAT-3' | (SEQ ID NO: 149)<br>(SEQ ID NO: 464)<br>(SEQ ID NO: 779) |
| MCL1-2874 Target: | 5'-ACCAAGAGUCCACAGACCUUUCAtc-3'<br>3'-GGUGGUUCUCAGGUGUCUGGAAAGUAG-5'<br>5'-CCACCAAGAGTCCACAGACCTTTCATC-3' | (SEQ ID NO: 150)<br>(SEQ ID NO: 465)<br>(SEQ ID NO: 780) |
| MCL1-2875 Target: | 5'-CCAAGAGUCCACAGACCUUUCAUct-3'<br>3'-GUGGUUCUCAGGUGUCUGGAAAGUAGA-5'<br>5'-CACCAAGAGTCCACAGACCTTTCATCT-3' | (SEQ ID NO: 151)<br>(SEQ ID NO: 466)<br>(SEQ ID NO: 781) |
| MCL1-2881 Target: | 5'-GUCCACAGACCUUUCAUCUUUCAcg-3'<br>3'-CUCAGGGUCUCGGAAAGUAGAAAGUGC-5'<br>5'-GAGTCCACAGACCTTTCATCTTTCACG-3' | (SEQ ID NO: 152)<br>(SEQ ID NO: 467)<br>(SEQ ID NO: 782) |
| MCL1-2882 Target: | 5'-UCCACAGACCUUUCAUCUUUCACga-3'<br>3'-UCAGGUGUCUGGAAAGUAGAAAGUGCU-5'<br>5'-AGTCCACAGACCTTTCATCTTTCACGA-3' | (SEQ ID NO: 153)<br>(SEQ ID NO: 468)<br>(SEQ ID NO: 783) |

TABLE 2-continued

Selected Human Anti-MCL1 DsiRNA Agents (Asymmetrics)

| | | |
|---|---|---|
| MCL1-2883 Target: | 5'-CCACAGACCUUUCAUCUUUCACGaa-3'<br>3'-CAGGUGUCUGGAAAGUAGAAAGUGCUU-5'<br>5'-GTCCACAGACCTTTCATCTTTCACGAA-3' | (SEQ ID NO: 154)<br>(SEQ ID NO: 469)<br>(SEQ ID NO: 784) |
| MCL1-2884 Target: | 5'-CACAGACCUUUCAUCUUUCACGAac-3'<br>3'-AGGUGUCUGGAAAGUAGAAAGUGCUUG-5'<br>5'-TCCACAGACCTTTCATCTTTCACGAAC-3' | (SEQ ID NO: 155)<br>(SEQ ID NO: 470)<br>(SEQ ID NO: 785) |
| MCL1-2887 Target: | 5'-AGACCUUUCAUCUUUCACGAACUtg-3'<br>3'-UGUCUGGAAAGUAGAAAGUGCUUGAAC-5'<br>5'-ACAGACCTTTCATCTTTCACGAACTTG-3' | (SEQ ID NO: 156)<br>(SEQ ID NO: 471)<br>(SEQ ID NO: 786) |
| MCL1-2890 Target: | 5'-CCUUUCAUCUUUCACGAACUUGAtc-3'<br>3'-CUGGAAAGUAGAAAGUGCUUGAACUAG-5'<br>5'-GACCTTTCATCTTTCACGAACTTGATC-3' | (SEQ ID NO: 157)<br>(SEQ ID NO: 472)<br>(SEQ ID NO: 787) |
| MCL1-2945 Target: | 5'-GUGACACUAACAGUCAUUGAGAGgt-3'<br>3'-GACACUGUGAUUGUCAGUAACUCUCCA-5'<br>5'-CTGTGACACTAACAGTCATTGAGAGGT-3' | (SEQ ID NO: 158)<br>(SEQ ID NO: 473)<br>(SEQ ID NO: 788) |
| MCL1-2951 Target: | 5'-CUAACAGUCAUUGAGAGGUGGGAgg-3'<br>3'-GUGAUUGUCAGUAACUCUCCACCCUCC-5'<br>5'-CACTAACAGTCATTGAGAGGTGGGAGG-3' | (SEQ ID NO: 159)<br>(SEQ ID NO: 474)<br>(SEQ ID NO: 789) |
| MCL1-3114 Target: | 5'-GGAGUAUGCUCACUUAAAUUUACag-3'<br>3'-AUCCUCAUACGAGUGAAUUUAAAUGUC-5'<br>5'-TAGGAGTATGCTCACTTAAATTTACAG-3' | (SEQ ID NO: 160)<br>(SEQ ID NO: 475)<br>(SEQ ID NO: 790) |
| MCL1-3123 Target: | 5'-UCACUUAAAUUUACAGAAAGAGGtg-3'<br>3'-CGAGUGAAUUUAAAUGUCUUUCUCCAC-5'<br>5'-GCTCACTTAAATTTACAGAAAGAGGTG-3' | (SEQ ID NO: 161)<br>(SEQ ID NO: 476)<br>(SEQ ID NO: 791) |
| MCL1-3126 Target: | 5'-CUUAAAUUUACAGAAAGAGGUGAgc-3'<br>3'-GUGAAUUUAAAUGUCUUUCUCCACUCG-5'<br>5'-CACTTAAATTTACAGAAAGAGGTGAGC-3' | (SEQ ID NO: 162)<br>(SEQ ID NO: 477)<br>(SEQ ID NO: 792) |
| MCL1-3186 Target: | 5'-ACUGAAGAAAGUGUCUAUAUUGGaa-3'<br>3'-UUUGACUUCUUUCACAGAUAUAACCUU-5'<br>5'-AAACTGAAGAAAGTGTCTATATTGGAA-3' | (SEQ ID NO: 163)<br>(SEQ ID NO: 478)<br>(SEQ ID NO: 793) |
| MCL1-3207 Target: | 5'-GGAACUAGGGUCAUUUGAAAGCUtc-3'<br>3'-AACCUUGAUCCCAGUAAACUUUCGAAG-5'<br>5'-TTGGAACTAGGGTCATTTGAAAGCTTC-3' | (SEQ ID NO: 164)<br>(SEQ ID NO: 479)<br>(SEQ ID NO: 794) |
| MCL1-3211 Target: | 5'-CUAGGGUCAUUUGAAAGCUUCAGtc-3'<br>3'-UUGAUCCCAGUAAACUUUCGAAGUCAG-5'<br>5'-AACTAGGGTCATTTGAAAGCTTCAGTC-3' | (SEQ ID NO: 165)<br>(SEQ ID NO: 480)<br>(SEQ ID NO: 795) |
| MCL1-3212 Target: | 5'-UAGGGUCAUUUGAAAGCUUCAGUct-3'<br>3'-UGAUCCCAGUAAACUUUCGAAGUCAGA-5'<br>5'-ACTAGGGTCATTTGAAAGCTTCAGTCT-3' | (SEQ ID NO: 166)<br>(SEQ ID NO: 481)<br>(SEQ ID NO: 796) |
| MCL1-3213 Target: | 5'-AGGGUCAUUUGAAAGCUUCAGUCtc-3'<br>3'-GAUCCCAGUAAACUUUCGAAGUCAGAG-5'<br>5'-CTAGGGTCATTTGAAAGCTTCAGTCTC-3' | (SEQ ID NO: 167)<br>(SEQ ID NO: 482)<br>(SEQ ID NO: 797) |
| MCL1-3214 Target: | 5'-GGGUCAUUUGAAAGCUUCAGUCUcg-3'<br>3'-AUCCCAGUAAACUUUCGAAGUCAGAGC-5'<br>5'-TAGGGTCATTTGAAAGCTTCAGTCTCG-3' | (SEQ ID NO: 168)<br>(SEQ ID NO: 483)<br>(SEQ ID NO: 798) |
| MCL1-3215 Target: | 5'-GGUCAUUUGAAAGCUUCAGUCUCgg-3'<br>3'-UCCCAGUAAACUUUCGAAGUCAGAGCC-5'<br>5'-AGGGTCATTTGAAAGCTTCAGTCTCGG-3' | (SEQ ID NO: 169)<br>(SEQ ID NO: 484)<br>(SEQ ID NO: 799) |
| MCL1-3232 Target: | 5'-AGUCUCGGAACAUGACCUUUAGUct-3'<br>3'-AGUCAGAGCCUUGUACUGGAAAUCAGA-5'<br>5'-TCAGTCTCGGAACATGACCTTTAGTCT-3' | (SEQ ID NO: 170)<br>(SEQ ID NO: 485)<br>(SEQ ID NO: 800) |
| MCL1-3239 Target: | 5'-GAACAUGACCUUUAGUCUGUGGAct-3'<br>3'-GCCUUGUACUGGAAAUCAGACACCUGA-5'<br>5'-CGGAACATGACCTTTAGTCTGTGGACT-3' | (SEQ ID NO: 171)<br>(SEQ ID NO: 486)<br>(SEQ ID NO: 801) |
| MCL1-3241 Target: | 5'-ACAUGACCUUUAGUCUGUGGACUcc-3'<br>3'-CUUGUACUGGAAAUCAGACACCUGAGG-5'<br>5'-GAACATGACCTTTAGTCTGTGGACTCC-3' | (SEQ ID NO: 172)<br>(SEQ ID NO: 487)<br>(SEQ ID NO: 802) |

TABLE 2-continued

Selected Human Anti-MCL1 DsiRNA Agents (Asymmetrics)

| | | |
|---|---|---|
| MCL1-3265 Target: | 5'-CAUUUAAAAAUAGGUAUGAAUAAga-3'<br>3'-AGGUAAAUUUUUAUCCAUACUUAUUCU-5'<br>5'-TCCATTTAAAAATAGGTATGAATAAGA-3' | (SEQ ID NO: 173)<br>(SEQ ID NO: 488)<br>(SEQ ID NO: 803) |
| MCL1-3277 Target: | 5'-GGUAUGAAUAAGAUGACUAAGAAtg-3'<br>3'-AUCCAUACUUAUUCUACUGAUUCUUAC-5'<br>5'-TAGGTATGAATAAGATGACTAAGAATG-3' | (SEQ ID NO: 174)<br>(SEQ ID NO: 489)<br>(SEQ ID NO: 804) |
| MCL1-3326 Target: | 5'-GCCCAUCUCAGAGCCAUAAGGUCat-3'<br>3'-GACGGGUAGAGUCUCGGUAUUCCAGUA-5'<br>5'-CTGCCCATCTCAGAGCCATAAGGTCAT-3' | (SEQ ID NO: 175)<br>(SEQ ID NO: 490)<br>(SEQ ID NO: 805) |
| MCL1-3370 Target: | 5'-ACCUAUGUAUUUAUCGUUCUUGAtc-3'<br>3'-AAUGGAUACAUAAAUAGCAAGAACUAG-5'<br>5'-TTACCTATGTATTTATCGTTCTTGATC-3' | (SEQ ID NO: 176)<br>(SEQ ID NO: 491)<br>(SEQ ID NO: 806) |
| MCL1-3399 Target: | 5'-GCCGCUUAUUUAUAUCAUGUAUCtc-3'<br>3'-UUCGGCGAAUAAAUAUAGUACAUAGAG-5'<br>5'-AAGCCGCTTATTTATATCATGTATCTC-3' | (SEQ ID NO: 177)<br>(SEQ ID NO: 492)<br>(SEQ ID NO: 807) |
| MCL1-3446 Target: | 5'-GUAGUUUUUAAUUAAUCUUAAGAtc-3'<br>3'-UACAUCAAAAAUUAAUUAGAAUUCUAG-5'<br>5'-ATGTAGTTTTTAATTAATCTTAAGATC-3' | (SEQ ID NO: 178)<br>(SEQ ID NO: 493)<br>(SEQ ID NO: 808) |
| MCL1-3492 Target: | 5'-CCUGUCUGCCAAAUCCAGUGGAAac-3'<br>3'-UCGGACAGACGGUUUAGGUCACCUUUG-5'<br>5'-AGCCTGTCTGCCAAATCCAGTGGAAAC-3' | (SEQ ID NO: 179)<br>(SEQ ID NO: 494)<br>(SEQ ID NO: 809) |
| MCL1-3498 Target: | 5'-UGCCAAAUCCAGUGGAAACAAGUgc-3'<br>3'-AGACGGUUUAGGUCACCUUUGUUCACG-5'<br>5'-TCTGCCAAATCCAGTGGAAACAAGTGC-3' | (SEQ ID NO: 180)<br>(SEQ ID NO: 495)<br>(SEQ ID NO: 810) |
| MCL1-3508 Target: | 5'-AGUGGAAACAAGUGCAUAGAUGUga-3'<br>3'-GGUCACCUUUGUUCACGUAUCUACACU-5'<br>5'-CCAGTGGAAACAAGTGCATAGATGTGA-3' | (SEQ ID NO: 181)<br>(SEQ ID NO: 496)<br>(SEQ ID NO: 811) |
| MCL1-3511 Target: | 5'-GGAAACAAGUGCAUAGAUGUGAAtt-3'<br>3'-CACCUUUGUUCACGUAUCUACACUUAA-5'<br>5'-GTGGAAACAAGTGCATAGATGTGAATT-3' | (SEQ ID NO: 182)<br>(SEQ ID NO: 497)<br>(SEQ ID NO: 812) |
| MCL1-3552 Target: | 5'-ACUUCCCAAUUCAUUAGGUAUGAct-3'<br>3'-GGUGAAGGGUUAAGUAAUCCAUACUGA-5'<br>5'-CCACTTCCCAATTCATTAGGTATGACT-3' | (SEQ ID NO: 183)<br>(SEQ ID NO: 498)<br>(SEQ ID NO: 813) |
| MCL1-3568 Target: | 5'-GGUAUGACUGUGGAAAUACAGACaa-3'<br>3'-AUCCAUACUGACACCUUUAUGUCUGUU-5'<br>5'-TAGGTATGACTGTGGAAATACAGACAA-3' | (SEQ ID NO: 184)<br>(SEQ ID NO: 499)<br>(SEQ ID NO: 814) |
| MCL1-3573 Target: | 5'-GACUGUGGAAAUACAGACAAGGAtc-3'<br>3'-UACUGACACCUUUAUGUCUGUUCCUAG-5'<br>5'-ATGACTGTGGAAATACAGACAAGGATC-3' | (SEQ ID NO: 185)<br>(SEQ ID NO: 500)<br>(SEQ ID NO: 815) |
| MCL1-3574 Target: | 5'-ACUGUGGAAAUACAGACAAGGAUct-3'<br>3'-ACUGACACCUUUAUGUCUGUUCCUAGA-5'<br>5'-TGACTGTGGAAATACAGACAAGGATCT-3' | (SEQ ID NO: 186)<br>(SEQ ID NO: 501)<br>(SEQ ID NO: 816) |
| MCL1-3576 Target: | 5'-UGUGGAAAUACAGACAAGGAUCUta-3'<br>3'-UGACACCUUUAUGUCUGUUCCUAGAAU-5'<br>5'-ACTGTGGAAATACAGACAAGGATCTTA-3' | (SEQ ID NO: 187)<br>(SEQ ID NO: 502)<br>(SEQ ID NO: 817) |
| MCL1-3577 Target: | 5'-GUGGAAAUACAGACAAGGAUCUUag-3'<br>3'-GACACCUUUAUGUCUGUUCCUAGAAUC-5'<br>5'-CTGTGGAAATACAGACAAGGATCTTAG-3' | (SEQ ID NO: 188)<br>(SEQ ID NO: 503)<br>(SEQ ID NO: 818) |
| MCL1-3578 Target: | 5'-UGGAAAUACAGACAAGGAUCUUAgt-3'<br>3'-ACACCUUUAUGUCUGUUCCUAGAAUCA-5'<br>5'-TGTGGAAATACAGACAAGGATCTTAGT-3' | (SEQ ID NO: 189)<br>(SEQ ID NO: 504)<br>(SEQ ID NO: 819) |
| MCL1-3579 Target: | 5'-GGAAAUACAGACAAGGAUCUUAGtt-3'<br>3'-CACCUUUAUGUCUGUUCCUAGAAUCAA-5'<br>5'-GTGGAAATACAGACAAGGATCTTAGTT-3' | (SEQ ID NO: 190)<br>(SEQ ID NO: 505)<br>(SEQ ID NO: 820) |
| MCL1-3580 Target: | 5'-GAAAUACAGACAAGGAUCUUAGUtg-3'<br>3'-ACCUUUAUGUCUGUUCCUAGAAUCAAC-5'<br>5'-TGGAAATACAGACAAGGATCTTAGTTG-3' | (SEQ ID NO: 191)<br>(SEQ ID NO: 506)<br>(SEQ ID NO: 821) |

TABLE 2-continued

Selected Human Anti-MCL1 DsiRNA Agents (Asymmetrics)

| | | |
|---|---|---|
| | 5'-GGAGGAGGCAGGUGGUCUAAGUGct-3' | (SEQ ID NO: 192) |
| | 3'-CUCCUCCUCCGUCCACCAGAUUCACGA-5' | (SEQ ID NO: 507) |
| MCL1-3690 Target: | 5'-GAGGAGGAGGCAGGTGGTCTAAGTGCT-3' | (SEQ ID NO: 822) |
| | 5'-GCUACGUAGUUCGGGCAAAUCCUcc-3' | (SEQ ID NO: 193) |
| | 3'-ACCGAUGCAUCAAGCCCGUUUAGGAGG-5' | (SEQ ID NO: 508) |
| MCL1-3720 Target: | 5'-TGGCTACGTAGTTCGGGCAAATCCTCC-3' | (SEQ ID NO: 823) |
| | 5'-AGGAUUUGCUUAGAAGGAUGGCGct-3' | (SEQ ID NO: 194) |
| | 3'-CCUCCUAAACGAAUCUUCCUACCGCGA-5' | (SEQ ID NO: 509) |
| MCL1-3758 Target: | 5'-GGAGGATTTGCTTAGAAGGATGGCGCT-3' | (SEQ ID NO: 824) |
| | 5'-GGAUUUGCUUAGAAGGAUGGCGCtc-3' | (SEQ ID NO: 195) |
| | 3'-CUCCUAAACGAAUCUUCCUACCGCGAG-5' | (SEQ ID NO: 510) |
| MCL1-3759 Target: | 5'-GAGGATTTGCTTAGAAGGATGGCGCTC-3' | (SEQ ID NO: 825) |
| | 5'-CCUCUAGUGUUUCAUGUACAUUCtg-3' | (SEQ ID NO: 196) |
| | 3'-CAGGAGAUCACAAAGUACAUGUAAGAC-5' | (SEQ ID NO: 511) |
| MCL1-3844 Target: | 5'-GTCCTCTAGTGTTTCATGTACATTCTG-3' | (SEQ ID NO: 826) |
| | 5'-ACACCUUGGUUCUGGUUAAACAGct-3' | (SEQ ID NO: 197) |
| | 3'-CUUGUGGAACCAAGACCAAUUUGUCGA-5' | (SEQ ID NO: 512) |
| MCL1-3879 Target: | 5'-GAACACCTTGGTTCTGGTTAAACAGCT-3' | (SEQ ID NO: 827) |
| | 5'-AGCUGUGCCAGGAAGGGUUAGGAcc-3' | (SEQ ID NO: 198) |
| | 3'-UAUCGACACGGUCCUUCCCAAUCCUGG-5' | (SEQ ID NO: 513) |
| MCL1-3915 Target: | 5'-ATAGCTGTGCCAGGAAGGGTTAGGACC-3' | (SEQ ID NO: 828) |
| | 5'-AGGAAGGGUUAGGACCAACUACAaa-3' | (SEQ ID NO: 199) |
| | 3'-GGUCCUUCCCAAUCCUGGUUGAUGUUU-5' | (SEQ ID NO: 514) |
| MCL1-3924 Target: | 5'-CCAGGAAGGGTTAGGACCAACTACAAA-3' | (SEQ ID NO: 829) |
| | 5'-GGUUAGGACCAACUACAAAAUUAAtg-3' | (SEQ ID NO: 200) |
| | 3'-UCCCAAUCCUGGUUGAUGUUUAAUUAC-5' | (SEQ ID NO: 515) |
| MCL1-3930 Target: | 5'-AGGGTTAGGACCAACTACAAATTAATG-3' | (SEQ ID NO: 830) |
| | 5'-GAAGACGAUGUGAAAUCGUUGUCtc-3' | (SEQ ID NO: 2206) |
| | 3'-UGCUUCUGCUACACUUUAGCAACAGAG-5' | (SEQ ID NO: 2302) |
| MCL1-872 Target: | 5'-ACGAAGACGATGTGAAATCGTTGTCTC-3' | (SEQ ID NO: 2398) |
| | 5'-AGGAUUGUGACUCUCAUUUCUUUtg-3' | (SEQ ID NO: 2207) |
| | 3'-CGUCCUAACACUGAGAGUAAAGAAAAC-5' | (SEQ ID NO: 2303) |
| MCL1-941 Target: | 5'-GCAGGATTGTGACTCTCATTTCTTTTG-3' | (SEQ ID NO: 2399) |
| | 5'-GAUUGUGACUCUCAUUUCUUUUGgt-3' | (SEQ ID NO: 2208) |
| | 3'-UCCUAACACUGAGAGUAAAGAAAACCA-5' | (SEQ ID NO: 2304) |
| MCL1-943 Target: | 5'-AGGATTGTGACTCTCATTTCTTTTGGT-3' | (SEQ ID NO: 2400) |
| | 5'-GGUGCCUUUGUGGCUAAACACUUga-3' | (SEQ ID NO: 2209) |
| | 3'-AACCACGGAAACACCGAUUUGUGAACU-5' | (SEQ ID NO: 2305) |
| MCL1-965 Target: | 5'-TTGGTGCCTTTGTGGCTAAACACTTGA-3' | (SEQ ID NO: 2401) |
| | 5'-GCCUUUGUGGCUAAACACUUGAAga-3' | (SEQ ID NO: 2210) |
| | 3'-CACGGAAACACCGAUUUGUGAACUUCU-5' | (SEQ ID NO: 2306) |
| MCL1-968 Target: | 5'-GTGCCTTTGTGGCTAAACACTTGAAGA-3' | (SEQ ID NO: 2402) |
| | 5'-GGUUUGUGGAGUUCUUCCAUGUAga-3' | (SEQ ID NO: 2211) |
| | 3'-ACCCAAACACCUCAAGAAGGUACAUCU-5' | (SEQ ID NO: 2307) |
| MCL1-1095 Target: | 5'-TGGGTTTGTGGAGTTCTTCCATGTAGA-3' | (SEQ ID NO: 2403) |
| | 5'-CCUAGCAACCUAGCCAGAAAAGCaa-3' | (SEQ ID NO: 2212) |
| | 3'-UGGGAUCGUUGGAUCGGUCUUUUCGUU-5' | (SEQ ID NO: 2308) |
| MCL1-1308 Target: | 5'-ACCCTAGCAACCTAGCCAGAAAAGCAA-3' | (SEQ ID NO: 2404) |
| | 5'-GCAACCUAGCCAGAAAAGCAAGUgg-3' | (SEQ ID NO: 2213) |
| | 3'-AUCGUUGGAUCGGUCUUUUCGUUCACC-5' | (SEQ ID NO: 2309) |
| MCL1-1312 Target: | 5'-TAGCAACCTAGCCAGAAAAGCAAGTGG-3' | (SEQ ID NO: 2405) |
| | 5'-AAAAGCAAGUGGCAAGAGGAUUAtg-3' | (SEQ ID NO: 2214) |
| | 3'-UCUUUUCGUUCACCGUUCUCCUAAUAC-5' | (SEQ ID NO: 2310) |
| MCL1-1325 Target: | 5'-AGAAAAGCAAGTGGCAAGAGGATTATG-3' | (SEQ ID NO: 2406) |
| | 5'-AAGAGGAUUAUGGCUAACAAGAAta-3' | (SEQ ID NO: 2215) |
| | 3'-CGUUCUCCUAAUACCGAUUGUUCUUAU-5' | (SEQ ID NO: 2311) |
| MCL1-1338 Target: | 5'-GCAAGAGGATTATGGCTAACAAGAATA-3' | (SEQ ID NO: 2407) |

TABLE 2-continued

Selected Human Anti-MCL1 DsiRNA Agents (Asymmetrics)

| | | |
|---|---|---|
| | 5'-GGAUUAUGGCUAACAAGAAUAAAta-3' | (SEQ ID NO: 2216) |
| | 3'-CUCCUAAUACCGAUUGUUCUUAUUUAU-5' | (SEQ ID NO: 2312) |
| MCL1-1342 Target: | 5'-GAGGATTATGGCTAACAAGAATAAATA-3' | (SEQ ID NO: 2408) |
| | 5'-AUUAUGGCUAACAAGAAUAAAUAca-3' | (SEQ ID NO: 2217) |
| | 3'-CCUAAUACCGAUUGUUCUUAUUUAUGU-5' | (SEQ ID NO: 2313) |
| MCL1-1344 Target: | 5'-GGATTATGGCTAACAAGAATAAATACA-3' | (SEQ ID NO: 2409) |
| | 5'-GGCUAACAAGAAUAAAUACAUGGGa-3' | (SEQ ID NO: 2218) |
| | 3'-UACCGAUUGUUCUUAUUUAUGUACCCU-5' | (SEQ ID NO: 2314) |
| MCL1-1349 Target: | 5'-ATGGCTAACAAGAATAAATACATGGGA-3' | (SEQ ID NO: 2410) |
| | 5'-GAAGAGUCACUGUCUGAAAGAAGca-3' | (SEQ ID NO: 2219) |
| | 3'-AACUUCUCAGUGACAGACUUUCUUCGU-5' | (SEQ ID NO: 2315) |
| MCL1-1393 Target: | 5'-TTGAAGAGTCACTGTCTGAAAGAAGCA-3' | (SEQ ID NO: 2411) |
| | 5'-AGUCACUGUCUGAAAGAAGCAAAgt-3' | (SEQ ID NO: 2220) |
| | 3'-UCUCAGUGACAGACUUUCUUCGUUUCA-5' | (SEQ ID NO: 2316) |
| MCL1-1397 Target: | 5'-AGAGTCACTGTCTGAAAGAAGCAAAGT-3' | (SEQ ID NO: 2412) |
| | 5'-CACUGUCUGAAAGAAGCAAAGUUca-3' | (SEQ ID NO: 2221) |
| | 3'-CAGUGACAGACUUUCUUCGUUUCAAGU-5' | (SEQ ID NO: 2317) |
| MCL1-1400 Target: | 5'-GTCACTGTCTGAAAGAAGCAAAGTTCA-3' | (SEQ ID NO: 2413) |
| | 5'-GUAGCCAGGCAAGUCAUAGAAUUga-3' | (SEQ ID NO: 2222) |
| | 3'-GUCAUCGGUCCGUUCAGUAUCUUAACU-5' | (SEQ ID NO: 2318) |
| MCL1-1539 Target: | 5'-CAGTAGCCAGGCAAGTCATAGAATTGA-3' | (SEQ ID NO: 2414) |
| | 5'-CAGGCAAGUCAUAGAAUUGAUUAcc-3' | (SEQ ID NO: 2223) |
| | 3'-CGGUCCGUUCAGUAUCUUAACUAAUGG-5' | (SEQ ID NO: 2319) |
| MCL1-1544 Target: | 5'-GCCAGGCAAGTCATAGAATTGATTACC-3' | (SEQ ID NO: 2415) |
| | 5'-GAUUACCCGCCGAAUUCAUUAAUtt-3' | (SEQ ID NO: 2224) |
| | 3'-AACUAAUGGGCGGCUUAAGUAAUUAAA-5' | (SEQ ID NO: 2320) |
| MCL1-1562 Target: | 5'-TTGATTACCCGCCGAATTCATTAATTT-3' | (SEQ ID NO: 2416) |
| | 5'-CCGCCGAAUUCAUUAAUUUACUGta-3' | (SEQ ID NO: 2225) |
| | 3'-UGGGCGGCUUAAGUAAUUAAAUGACAU-5' | (SEQ ID NO: 2321) |
| MCL1-1568 Target: | 5'-ACCCGCCGAATTCATTAATTTACTGTA-3' | (SEQ ID NO: 2417) |
| | 5'-GAAUUCAUUAAUUUACUGUAGUGtt-3' | (SEQ ID NO: 2226) |
| | 3'-GGCUUAAGUAAUUAAAUGACAUCACAA-5' | (SEQ ID NO: 2322) |
| MCL1-1573 Target: | 5'-CCGAATTCATTAATTTACTGTAGTGTT-3' | (SEQ ID NO: 2418) |
| | 5'-CCAAGUGUUCAGGACUUUUAUACct-3' | (SEQ ID NO: 2227) |
| | 3'-CAGGUUCACAAGUCCUGAAAAUAUGGA-5' | (SEQ ID NO: 2323) |
| MCL1-1732 Target: | 5'-GTCCAAGTGTTCAGGACTTTTATACCT-3' | (SEQ ID NO: 2419) |
| | 5'-AAGUGUUCAGGACUUUUAUACCUgt-3' | (SEQ ID NO: 2228) |
| | 3'-GGUUCACAAGUCCUGAAAAUAUGGACA-5' | (SEQ ID NO: 2324) |
| MCL1-1734 Target: | 5'-CCAAGTGTTCAGGACTTTTATACCTGT-3' | (SEQ ID NO: 2420) |
| | 5'-UCAGGACUUUUAUACCUGUUAUAct-3' | (SEQ ID NO: 2229) |
| | 3'-CAAGUCCUGAAAAUAUGGACAAUAUGA-5' | (SEQ ID NO: 2325) |
| MCL1-1740 Target: | 5'-GTTCAGGACTTTTATACCTGTTATACT-3' | (SEQ ID NO: 2421) |
| | 5'-AGGACUUUUAUACCUGUUAUACUtt-3' | (SEQ ID NO: 2230) |
| | 3'-AGUCCUGAAAAUAUGGACAAUAUGAAA-5' | (SEQ ID NO: 2326) |
| MCL1-1742 Target: | 5'-TCAGGACTTTTATACCTGTTATACTTT-3' | (SEQ ID NO: 2422) |
| | 5'-CUUUUAUACCUGUUAUACUUUGGct-3' | (SEQ ID NO: 2231) |
| | 3'-CUGAAAAUAUGGACAAUAUGAAACCGA-5' | (SEQ ID NO: 2327) |
| MCL1-1746 Target: | 5'-GACTTTTATACCTGTTATACTTTGGCT-3' | (SEQ ID NO: 2423) |
| | 5'-CUAGUUUAUCACCAAUAAUACUUga-3' | (SEQ ID NO: 2232) |
| | 3'-CGGAUCAAAUAGUGGUUAUUAUGAACU-5' | (SEQ ID NO: 2328) |
| MCL1-1799 Target: | 5'-GCCTAGTTTATCACCAATAATACTTGA-3' | (SEQ ID NO: 2424) |
| | 5'-GACGGAAGGCUCAGUAAUUAGUUat-3' | (SEQ ID NO: 2233) |
| | 3'-AACUGCCUUCCGAGUCAUUAAUCAAUA-5' | (SEQ ID NO: 2329) |
| MCL1-1822 Target: | 5'-TTGACGGAAGGCTCAGTAATTAGTTAT-3' | (SEQ ID NO: 2425) |
| | 5'-CGGAAGGCUCAGUAAUUAGUUAUga-3' | (SEQ ID NO: 2234) |
| | 3'-CUGCCUUCCGAGUCAUUAAUCAAUACU-5' | (SEQ ID NO: 2330) |
| MCL1-1824 Target: | 5'-GACGGAAGGCTCAGTAATTAGTTATGA-3' | (SEQ ID NO: 2426) |

TABLE 2-continued

Selected Human Anti-MCL1 DsiRNA Agents (Asymmetrics)

|  |  |  |
|---|---|---|
| MCL1-1826 Target: | 5'-GAAGGCUCAGUAAUUAGUUAUGAat-3'<br>3'-GCCUUCCGAGUCAUUAAUCAAUACUUA-5'<br>5'-CGGAAGGCTCAGTAATTAGTTATGAAT-3' | (SEQ ID NO: 2235)<br>(SEQ ID NO: 2331)<br>(SEQ ID NO: 2427) |
| MCL1-1831 Target: | 5'-CUCAGUAAUUAGUUAUGAAUAUGga-3'<br>3'-CCGAGUCAUUAAUCAAUACUUAUACCU-5'<br>5'-GGCTCAGTAATTAGTTATGAATATGGA-3' | (SEQ ID NO: 2236)<br>(SEQ ID NO: 2332)<br>(SEQ ID NO: 2428) |
| MCL1-1833 Target: | 5'-CAGUAAUUAGUUAUGAAUAUGGAta-3'<br>3'-GAGUCAUUAAUCAAUACUUAUACCUAU-5'<br>5'-CTCAGTAATTAGTTATGAATATGGATA-3' | (SEQ ID NO: 2237)<br>(SEQ ID NO: 2333)<br>(SEQ ID NO: 2429) |
| MCL1-1872 Target: | 5'-GACAGCUUGUAAAUGUAUUUGUAaa-3'<br>3'-UUCUGUCGAACAUUUACAUAAACAUUU-5'<br>5'-AAGACAGCTTGTAAATGTATTTGTAAA-3' | (SEQ ID NO: 2238)<br>(SEQ ID NO: 2334)<br>(SEQ ID NO: 2430) |
| MCL1-1875 Target: | 5'-AGCUUGUAAAUGUAUUUGUAAAAat-3'<br>3'-UGUCGAACAUUUACAUAAACAUUUUUA-5'<br>5'-ACAGCTTGTAAATGTATTTGTAAAAAT-3' | (SEQ ID NO: 2239)<br>(SEQ ID NO: 2335)<br>(SEQ ID NO: 2431) |
| MCL1-1916 Target: | 5'-GAAAGUCUAUUUCUUUGAAACGAag-3'<br>3'-GUCUUUCAGAUAAAGAAACUUUGCUUC-5'<br>5'-CAGAAAGTCTATTTCTTTGAAACGAAG-3' | (SEQ ID NO: 2240)<br>(SEQ ID NO: 2336)<br>(SEQ ID NO: 2432) |
| MCL1-1948 Target: | 5'-CGAAUUUACAUUAGUUUUUUUCAta-3'<br>3'-UAGCUUAAAUGUAAUCAAAAAAGUAU-5'<br>5'-ATCGAATTTACATTAGTTTTTTTCATA-3' | (SEQ ID NO: 2241)<br>(SEQ ID NO: 2337)<br>(SEQ ID NO: 2433) |
| MCL1-1956 Target: | 5'-CAUUAGUUUUUUUCAUACCCUUUtg-3'<br>3'-AUGUAAUCAAAAAAGUAUGGGAAAAC-5'<br>5'-TACATTAGTTTTTTTCATACCCTTTTG-3' | (SEQ ID NO: 2242)<br>(SEQ ID NO: 2338)<br>(SEQ ID NO: 2434) |
| MCL1-1958 Target: | 5'-UUAGUUUUUUUCAUACCCUUUUGaa-3'<br>3'-GUAAUCAAAAAAGUAUGGGAAAACUU-5'<br>5'-CATTAGTTTTTTTCATACCCTTTTGAA-3' | (SEQ ID NO: 2243)<br>(SEQ ID NO: 2339)<br>(SEQ ID NO: 2435) |
| MCL1-1969 Target: | 5'-CAUACCCUUUUGAACUUUGCAACtt-3'<br>3'-AAGUAUGGGAAAACUUGAAACGUUGAA-5'<br>5'-TTCATACCCTTTTGAACTTTGCAACTT-3' | (SEQ ID NO: 2244)<br>(SEQ ID NO: 2340)<br>(SEQ ID NO: 2436) |
| MCL1-2021 Target: | 5'-CUUUUCUAUGCUAAACUUUGUUCtg-3'<br>3'-UCGAAAAGAUACGAUUUGAAACAAGAC-5'<br>5'-AGCTTTTCTATGCTAAACTTTGTTCTG-3' | (SEQ ID NO: 2245)<br>(SEQ ID NO: 2341)<br>(SEQ ID NO: 2437) |
| MCL1-2031 Target: | 5'-CUAAACUUUGUUCUGUUCAGUUCta-3'<br>3'-ACGAUUUGAAACAAGACAAGUCAAGAU-5'<br>5'-TGCTAAACTTTGTTCTGTTCAGTTCTA-3' | (SEQ ID NO: 2246)<br>(SEQ ID NO: 2342)<br>(SEQ ID NO: 2438) |
| MCL1-2033 Target: | 5'-AAACUUUGUUCUGUUCAGUUCUAga-3'<br>3'-GAUUUGAAACAAGACAAGUCAAGAUCU-5'<br>5'-CTAAACTTTGTTCTGTTCAGTTCTAGA-3' | (SEQ ID NO: 2247)<br>(SEQ ID NO: 2343)<br>(SEQ ID NO: 2439) |
| MCL1-2087 Target: | 5'-GUAUGCAGACUGGUUGUAGUGGAac-3'<br>3'-GACAUACGUCUGACCAACAUCACCUUG-5'<br>5'-CTGTATGCAGACTGGTTGTAGTGGAAC-3' | (SEQ ID NO: 2248)<br>(SEQ ID NO: 2344)<br>(SEQ ID NO: 2440) |
| MCL1-2091 Target: | 5'-GCAGACUGGUUGUAGUGGAACAAat-3'<br>3'-UACGUCUGACCAACAUCACCUUGUUUA-5'<br>5'-ATGCAGACTGGTTGTAGTGGAACAAAT-3' | (SEQ ID NO: 2249)<br>(SEQ ID NO: 2345)<br>(SEQ ID NO: 2441) |
| MCL1-2107 Target: | 5'-GGAACAAAUCUGAUAACUAUGCAgg-3'<br>3'-CACCUUGUUUAGACUAUUGAUACGUCC-5'<br>5'-GTGGAACAAATCTGATAACTATGCAGG-3' | (SEQ ID NO: 2250)<br>(SEQ ID NO: 2346)<br>(SEQ ID NO: 2442) |
| MCL1-2199 Target: | 5'-GAGAGGUUGAUGAAUGGAAAUUCtt-3'<br>3'-AACUCUCCAACUACUUACCUUUAAGAA-5'<br>5'-TTGAGAGGTTGATGAATGGAAATTCTT-3' | (SEQ ID NO: 2251)<br>(SEQ ID NO: 2347)<br>(SEQ ID NO: 2443) |
| MCL1-2212 Target: | 5'-AUGGAAAUUCUUUCACUUCAUUAta-3'<br>3'-CUUACCUUUAAGAAAGUGAAGUAAUAU-5'<br>5'-GAATGGAAATTCTTTCACTTCATTATA-3' | (SEQ ID NO: 2252)<br>(SEQ ID NO: 2348)<br>(SEQ ID NO: 2444) |
| MCL1-2215 Target: | 5'-GAAAUUCUUUCACUUCAUUAUAUgc-3'<br>3'-ACCUUUAAGAAAGUGAAGUAAUAUACG-5'<br>5'-TGGAAATTCTTTCACTTCATTATATGC-3' | (SEQ ID NO: 2253)<br>(SEQ ID NO: 2349)<br>(SEQ ID NO: 2445) |

TABLE 2-continued

Selected Human Anti-MCL1 DsiRNA Agents (Asymmetrics)

|   |   |   |
|---|---|---|
| MCL1-2217 | 5'-AAUUCUUUCACUUCAUUAUAUGCaa-3'<br>3'-CUUUAAGAAAGUGAAGUAAUAUACGUU-5'<br>Target: 5'-GAAATTCTTTCACTTCATTATATGCAA-3' | (SEQ ID NO: 2254)<br>(SEQ ID NO: 2350)<br>(SEQ ID NO: 2446) |
| MCL1-2225 | 5'-CACUUCAUUAUAUGCAAGUUUUCaa-3'<br>3'-AAGUGAAGUAAUAUACGUUCAAAAGUU-5'<br>Target: 5'-TTCACTTCATTATATGCAAGTTTTCAA-3' | (SEQ ID NO: 2255)<br>(SEQ ID NO: 2351)<br>(SEQ ID NO: 2447) |
| MCL1-2227 | 5'-CUUCAUUAUAUGCAAGUUUUCAAta-3'<br>3'-GUGAAGUAAUAUACGUUCAAAAGUUAU-5'<br>Target: 5'-CACTTCATTATATGCAAGTTTTCAATA-3' | (SEQ ID NO: 2256)<br>(SEQ ID NO: 2352)<br>(SEQ ID NO: 2448) |
| MCL1-2230 | 5'-CAUUAUAUGCAAGUUUUCAAUAAtt-3'<br>3'-AAGUAAUAUACGUUCAAAAGUUAUUAA-5'<br>Target: 5'-TTCATTATATGCAAGTTTTCAATAATT-3' | (SEQ ID NO: 2257)<br>(SEQ ID NO: 2353)<br>(SEQ ID NO: 2449) |
| MCL1-2232 | 5'-UUAUAUGCAAGUUUUCAAUAAUUag-3'<br>3'-GUAAUAUACGUUCAAAAGUUAUUAAUC-5'<br>Target: 5'-CATTATATGCAAGTTTTCAATAATTAG-3' | (SEQ ID NO: 2258)<br>(SEQ ID NO: 2354)<br>(SEQ ID NO: 2450) |
| MCL1-2236 | 5'-AUGCAAGUUUUCAAUAAUUAGGUct-3'<br>3'-UAUACGUUCAAAAGUUAUUAAUCCAGA-5'<br>Target: 5'-ATATGCAAGTTTTCAATAATTAGGTCT-3' | (SEQ ID NO: 2259)<br>(SEQ ID NO: 2355)<br>(SEQ ID NO: 2451) |
| MCL1-2275 | 5'-GGUUACUGAUGACUUACAAAUAAtg-3'<br>3'-UUCCAAUGACUACUGAAUGUUUAUUAC-5'<br>Target: 5'-AAGGTTACTGATGACTTACAAATAATG-3' | (SEQ ID NO: 2260)<br>(SEQ ID NO: 2356)<br>(SEQ ID NO: 2452) |
| MCL1-2304 | 5'-CUGAUUGGGCAAUACUCAUUUGAgt-3'<br>3'-GAGACUAACCCGUUAUGAGUAAACUCA-5'<br>Target: 5'-CTCTGATTGGGCAATACTCATTTGAGT-3' | (SEQ ID NO: 2261)<br>(SEQ ID NO: 2357)<br>(SEQ ID NO: 2453) |
| MCL1-2314 | 5'-AAUACUCAUUUGAGUUCCUUCCAtt-3'<br>3'-CGUUAUGAGUAAACUCAAGGAAGGUAA-5'<br>Target: 5'-GCAATACTCATTTGAGTTCCTTCCATT-3' | (SEQ ID NO: 2262)<br>(SEQ ID NO: 2358)<br>(SEQ ID NO: 2454) |
| MCL1-2352 | 5'-CUGGUGAAAUUUAAAGUGAAUUCat-3'<br>3'-UUGACCACUUUAAAUUUCACUUAAGUA-5'<br>Target: 5'-AACTGGTGAAATTTAAAGTGAATTCAT-3' | (SEQ ID NO: 2263)<br>(SEQ ID NO: 2359)<br>(SEQ ID NO: 2455) |
| MCL1-2473 | 5'-CAUUUGAUCCCUUGUUUGCUUAAta-3'<br>3'-CUGUAAACUAGGGAACAAACGAAUUAU-5'<br>Target: 5'-GACATTTGATCCCTTGTTTGCTTAATA-3' | (SEQ ID NO: 2264)<br>(SEQ ID NO: 2360)<br>(SEQ ID NO: 2456) |
| MCL1-2478 | 5'-GAUCCCUUGUUUGCUUAAUAAAUta-3'<br>3'-AACUAGGGAACAAACGAAUUAUUUAAU-5'<br>Target: 5'-TTGATCCCTTGTTTGCTTAATAAATTA-3' | (SEQ ID NO: 2265)<br>(SEQ ID NO: 2361)<br>(SEQ ID NO: 2457) |
| MCL1-2483 | 5'-CUUGUUUGCUUAAUAAAUUAUAAaa-3'<br>3'-GGGAACAAACGAAUUAUUUAAUAUUUU-5'<br>Target: 5'-CCCTTGTTTGCTTAATAAATTATAAAA-3' | (SEQ ID NO: 2266)<br>(SEQ ID NO: 2362)<br>(SEQ ID NO: 2458) |
| MCL1-2486 | 5'-GUUUGCUUAAUAAAUUAUAAAAUga-3'<br>3'-AACAAACGAAUUAUUUAAUAUUUUACU-5'<br>Target: 5'-TTGTTTGCTTAATAAATTATAAAATGA-3' | (SEQ ID NO: 2267)<br>(SEQ ID NO: 2363)<br>(SEQ ID NO: 2459) |
| MCL1-2501 | 5'-UAUAAAAUGAUGGCUUGGAAAAGca-3'<br>3'-UAAUAUUUUACUACCGAACCUUUUCGU-5'<br>Target: 5'-ATTATAAAATGATGGCTTGGAAAAGCA-3' | (SEQ ID NO: 2268)<br>(SEQ ID NO: 2364)<br>(SEQ ID NO: 2460) |
| MCL1-2575 | 5'-GGUCUAAGCCUAGUAUGUCAAUAaa-3'<br>3'-GUCCAGAUUCGGAUCAUACAGUUAUUU-5'<br>Target: 5'-CAGGTCTAAGCCTAGTATGTCAATAAA-3' | (SEQ ID NO: 2269)<br>(SEQ ID NO: 2365)<br>(SEQ ID NO: 2461) |
| MCL1-2584 | 5'-CUAGUAUGUCAAUAAAGCAAAUAct-3'<br>3'-CGGAUCAUACAGUUAUUUCGUUUAUGA-5'<br>Target: 5'-GCCTAGTATGTCAATAAAGCAAATACT-3' | (SEQ ID NO: 2270)<br>(SEQ ID NO: 2366)<br>(SEQ ID NO: 2462) |
| MCL1-2591 | 5'-GUCAAUAAAGCAAAUACUUACUGtt-3'<br>3'-UACAGUUAUUUCGUUUAUGAAUGACAA-5'<br>Target: 5'-ATGTCAATAAAGCAAATACTTACTGTT-3' | (SEQ ID NO: 2271)<br>(SEQ ID NO: 2367)<br>(SEQ ID NO: 2463) |
| MCL1-2593 | 5'-CAAUAAAGCAAAUACUUACUGUUtt-3'<br>3'-CAGUUAUUUCGUUUAUGAAUGACAAAA-5'<br>Target: 5'-GTCAATAAAGCAAATACTTACTGTTTT-3' | (SEQ ID NO: 2272)<br>(SEQ ID NO: 2368)<br>(SEQ ID NO: 2464) |

TABLE 2-continued

Selected Human Anti-MCL1 DsiRNA Agents (Asymmetrics)

|  |  |  |
|---|---|---|
| MCL1-2596 | 5'-UAAAGCAAAUACUUACUGUUUUGtt-3'<br>3'-UUAUUUCGUUUAUGAAUGACAAAACAA-5'<br>Target: 5'-AATAAAGCAAATACTTACTGTTTTGTT-3' | (SEQ ID NO: 2273)<br>(SEQ ID NO: 2369)<br>(SEQ ID NO: 2465) |
| MCL1-2598 | 5'-AAGCAAAUACUUACUGUUUUGUUtc-3'<br>3'-AUUUCGUUUAUGAAUGACAAAACAAAG-5'<br>Target: 5'-TAAAGCAAATACTTACTGTTTTGTTTC-3' | (SEQ ID NO: 2274)<br>(SEQ ID NO: 2370)<br>(SEQ ID NO: 2466) |
| MCL1-2602 | 5'-AAAUACUUACUGUUUUGUUUCUAtt-3'<br>3'-CGUUUAUGAAUGACAAAACAAAGAUAA-5'<br>Target: 5'-GCAAATACTTACTGTTTTGTTTCTATT-3' | (SEQ ID NO: 2275)<br>(SEQ ID NO: 2371)<br>(SEQ ID NO: 2467) |
| MCL1-2605 | 5'-UACUUACUGUUUUGUUUCUAUUAat-3'<br>3'-UUAUGAAUGACAAAACAAAGAUAAUUA-5'<br>Target: 5'-AATACTTACTGTTTTGTTTCTATTAAT-3' | (SEQ ID NO: 2276)<br>(SEQ ID NO: 2372)<br>(SEQ ID NO: 2468) |
| MCL1-2607 | 5'-CUUACUGUUUUGUUUCUAUUAAUga-3'<br>3'-AUGAAUGACAAAACAAAGAUAAUUACU-5'<br>Target: 5'-TACTTACTGTTTTGTTTCTATTAATGA-3' | (SEQ ID NO: 2277)<br>(SEQ ID NO: 2373)<br>(SEQ ID NO: 2469) |
| MCL1-2609 | 5'-UACUGUUUUGUUUCUAUUAAUGAtt-3'<br>3'-GAAUGACAAAACAAAGAUAAUUACUAA-5'<br>Target: 5'-CTTACTGTTTTGTTTCTATTAATGATT-3' | (SEQ ID NO: 2278)<br>(SEQ ID NO: 2374)<br>(SEQ ID NO: 2470) |
| MCL1-2613 | 5'-GUUUUGUUUCUAUUAAUGAUUCCca-3'<br>3'-GACAAAACAAAGAUAAUUACUAAGGGU-5'<br>Target: 5'-CTGTTTTGTTTCTATTAATGATTCCCA-3' | (SEQ ID NO: 2279)<br>(SEQ ID NO: 2375)<br>(SEQ ID NO: 2471) |
| MCL1-2625 | 5'-UUAAUGAUUCCCAAACCUUGUUGca-3'<br>3'-AUAAUUACUAAGGGUUUGGAACAACGU-5'<br>Target: 5'-TATTAATGATTCCCAAACCTTGTTGCA-3' | (SEQ ID NO: 2280)<br>(SEQ ID NO: 2376)<br>(SEQ ID NO: 2472) |
| MCL1-2636 | 5'-CAAACCUUGUUGCAAGUUUUUGcat-3'<br>3'-GGGUUUGGAACAACGUUCAAAAACGUA-5'<br>Target: 5'-CCCAAACCTTGTTGCAAGTTTTTGCAT-3' | (SEQ ID NO: 2281)<br>(SEQ ID NO: 2377)<br>(SEQ ID NO: 2473) |
| MCL1-2672 | 5'-GAUUUCAGUCUUGAUGUUUGUUCta-3'<br>3'-ACCUAAAGUCAGAACUACAAACAAGAU-5'<br>Target: 5'-TGGATTTCAGTCTTGATGTTTGTTCTA-3' | (SEQ ID NO: 2282)<br>(SEQ ID NO: 2378)<br>(SEQ ID NO: 2474) |
| MCL1-2679 | 5'-GUCUUGAUGUUUGUUCUAUCAGAct-3'<br>3'-GUCAGAACUACAAACAAGAUAGUCUGA-5'<br>Target: 5'-CAGTCTTGATGTTTGTTCTATCAGACT-3' | (SEQ ID NO: 2283)<br>(SEQ ID NO: 2379)<br>(SEQ ID NO: 2475) |
| MCL1-2790 | 5'-CUGCCAUCCCUGAACUCUUUCUAgc-3'<br>3'-GGGACGGUAGGGACUUGAGAAAGAUCG-5'<br>Target: 5'-CCCTGCCATCCCTGAACTCTTTCTAGC-3' | (SEQ ID NO: 2284)<br>(SEQ ID NO: 2380)<br>(SEQ ID NO: 2476) |
| MCL1-2799 | 5'-CUGAACUCUUUCUAGCCCUUUUAga-3'<br>3'-GGGACUUGAGAAAGAUCGGGAAAAUCU-5'<br>Target: 5'-CCCTGAACTCTTTCTAGCCCTTTTAGA-3' | (SEQ ID NO: 2285)<br>(SEQ ID NO: 2381)<br>(SEQ ID NO: 2477) |
| MCL1-2801 | 5'-GAACUCUUUCUAGCCCUUUUAGAtt-3'<br>3'-GACUUGAGAAAGAUCGGGAAAAUCUAA-5'<br>Target: 5'-CTGAACTCTTTCTAGCCCTTTTAGATT-3' | (SEQ ID NO: 2286)<br>(SEQ ID NO: 2382)<br>(SEQ ID NO: 2478) |
| MCL1-2911 | 5'-GAUCCUGUUAGCAGGUGGUAAUAcc-3'<br>3'-AACUAGGACAAUCGUCCACCAUUAUGG-5'<br>Target: 5'-TTGATCCTGTTAGCAGGTGGTAATACC-3' | (SEQ ID NO: 2287)<br>(SEQ ID NO: 2383)<br>(SEQ ID NO: 2479) |
| MCL1-2992 | 5'-GACUGGUAUCUUUUCAACUAUUGtt-3'<br>3'-ACCUGACCAUAGAAAAGUUGAUAACAA-5'<br>Target: 5'-TGGACTGGTATCTTTTCAACTATTGTT-3' | (SEQ ID NO: 2288)<br>(SEQ ID NO: 2384)<br>(SEQ ID NO: 2480) |
| MCL1-3072 | 5'-AAGAACAUUUUAUGAGGCUUUCUct-3'<br>3'-CUUUCUUGUAAAAUACUCCGAAAGAGA-5'<br>Target: 5'-GAAAGAACATTTTATGAGGCTTTCTCT-3' | (SEQ ID NO: 2289)<br>(SEQ ID NO: 2385)<br>(SEQ ID NO: 2481) |
| MCL1-3074 | 5'-GAACAUUUUAUGAGGCUUUCUCUaa-3'<br>3'-UUCUUGUAAAAUACUCCGAAAGAGAUU-5'<br>Target: 5'-AAGAACATTTTATGAGGCTTTCTCTAA-3' | (SEQ ID NO: 2290)<br>(SEQ ID NO: 2386)<br>(SEQ ID NO: 2482) |
| MCL1-3252 | 5'-AGUCUGUGGACUCCAUUUAAAAAta-3'<br>3'-AAUCAGACACCUGAGGUAAAUUUUUAU-5'<br>Target: 5'-TTAGTCTGTGGACTCCATTTAAAAATA-3' | (SEQ ID NO: 2291)<br>(SEQ ID NO: 2387)<br>(SEQ ID NO: 2483) |

TABLE 2-continued

Selected Human Anti-MCL1 DsiRNA Agents (Asymmetrics)

```
                  5'-CAUUAGGUAUGACUGUGGAAAUAca-3'   (SEQ ID NO: 2292)
                  3'-AAGUAAUCCAUACUGACACCUUUAUGU-5' (SEQ ID NO: 2388)
MCL1-3563 Target: 5'-TTCATTAGGTATGACTGTGGAAATACA-3' (SEQ ID NO: 2484)

5'-GACAAGGAUCUUAGUUGAUAUUUtg-3'   (SEQ ID NO: 2293)
                  3'-GUCUGUUCCUAGAAUCAACUAUAAAAC-5' (SEQ ID NO: 2389)
MCL1-3588 Target: 5'-CAGACAAGGATCTTAGTTGATATTTTG-3' (SEQ ID NO: 2485)

5'-GACUACUUUUUGACUUCUGUUUGtc-3'   (SEQ ID NO: 2294)
                  3'-CACUGAUGAAAAACUGAAGACAAACAG-5' (SEQ ID NO: 2390)
MCL1-3789 Target: 5'-GTGACTACTTTTTGACTTCTGTTTGTC-3' (SEQ ID NO: 2486)

5'-CUGUUUUUCCUGAGAAAAAAAAAta-3'   (SEQ ID NO: 2295)
                  3'-AAGACAAAAAGGACUCUUUUUUUUUAU-5' (SEQ ID NO: 2391)
MCL1-3989 Target: 5'-TTCTGTTTTTCCTGAGAAAAAAAAATA-3' (SEQ ID NO: 2487)

5'-GUUUUUCCUGAGAAAAAAAAAUAaa-3'   (SEQ ID NO: 2296)
                  3'-GACAAAAAGGACUCUUUUUUUUUAUUU-5' (SEQ ID NO: 2392)
MCL1-3991 Target: 5'-CTGTTTTTCCTGAGAAAAAAAAATAAA-3' (SEQ ID NO: 2488)

5'-CCUGAGAAAAAAAAAUAAAUCUUtt-3'   (SEQ ID NO: 2297)
                  3'-AAGGACUCUUUUUUUUUAUUUAGAAAA-5' (SEQ ID NO: 2393)
MCL1-3997 Target: 5'-TTCCTGAGAAAAAAAAATAAATCTTTT-3' (SEQ ID NO: 2489)

5'-GAGAAAAAAAAAUAAAUCUUUUAtt-3'   (SEQ ID NO: 2298)
                  3'-GACUCUUUUUUUUUAUUUAGAAAAUAA-5' (SEQ ID NO: 2394)
MCL1-4000 Target: 5'-CTGAGAAAAAAAAATAAATCTTTTATT-3' (SEQ ID NO: 2490)

5'-GAAAAAAAAAUAAAUCUUUUAUUca-3'   (SEQ ID NO: 2299)
                  3'-CUCUUUUUUUUUAUUUAGAAAAUAAGU-5' (SEQ ID NO: 2395)
MCL1-4002 Target: 5'-GAGAAAAAAAAATAAATCTTTTATTCA-3' (SEQ ID NO: 2491)

5'-AAAAUAAAUCUUUUAUUCAAAAAaa-3'   (SEQ ID NO: 2300)
                  3'-UUUUUUAUUUAGAAAAUAAGUUUUUUU-5' (SEQ ID NO: 2396)
MCL1-4008 Target: 5'-AAAAAATAAATCTTTTATTCAAAAAAA-3' (SEQ ID NO: 2492)
```

TABLE 3

Selected Human Anti-MCL1 DsiRNAs, Unmodified Duplexes (Asymmetrics)

```
                 5'-GCCACUUCUCACUUCCGCUUCCUUC-3'   (SEQ ID NO: 946)
                 3'-AGCGGUGAAGAGUGAAGGCGAAGGAAG-5' (SEQ ID NO: 316)
MCL1-72 Target:  5'-TCGCCACTTCTCACTTCCGCTTCCTTC-3' (SEQ ID NO: 631)

5'-ACUUCUCACUUCCGCUUCCUUCCAG-3'   (SEQ ID NO: 947)
                 3'-GGUGAAGAGUGAAGGCGAAGGAAGGUC-5' (SEQ ID NO: 317)
MCL1-75 Target:  5'-CCACTTCTCACTTCCGCTTCCTTCCAG-3' (SEQ ID NO: 632)

5'-GGCGGCGACUGGCAAUGUUUGGCCU-3'   (SEQ ID NO: 948)
                 3'-CGCCGCCGCUGACCGUUACAAACCGGA-5' (SEQ ID NO: 318)
MCL1-141 Target: 5'-GCGGCGGCGACTGGCAATGTTTGGCCT-3' (SEQ ID NO: 633)

5'-CGCGGUAAUCGGACUCAACCUCUAC-3'   (SEQ ID NO: 949)
                 3'-UUGCGCCAUUAGCCUGAGUUGGAGAUG-5' (SEQ ID NO: 319)
MCL1-175 Target: 5'-AACGCGGTAATCGGACTCAACCTCTAC-3' (SEQ ID NO: 634)

5'-AGGGCGACUUUUGGCUACGGAGAAG-3'   (SEQ ID NO: 950)
                 3'-CCUCCCGCUGAAAACCGAUGCCUCUUC-5' (SEQ ID NO: 320)
MCL1-250 Target: 5'-GGAGGGCGACTTTTGGCTACGGAGAAG-3' (SEQ ID NO: 635)

5'-GCGAGGCUGCUUUUCUUCGCGCCCA-3'   (SEQ ID NO: 951)
                 3'-GGCGCUCCGACGAAAAGAAGCGCGGGU-5' (SEQ ID NO: 321)
MCL1-434 Target: 5'-CCGCGAGGCTGCTTTTCTTCGCGCCCA-3' (SEQ ID NO: 636)

5'-UGGUAAUAACACCAGUACGGACGGG-3'   (SEQ ID NO: 952)
                 3'-AGACCAUUAUUGUGGUCAUGCCUGCCC-5' (SEQ ID NO: 322)
MCL1-604 Target: 5'-TCTGGTAATAACACCAGTACGGACGGG-3' (SEQ ID NO: 637)

5'-GGAGGAGGACGAGUUGUACCGGCAG-3'   (SEQ ID NO: 953)
                 3'-CUCCUCCUCCUGCUCAACAUGGCCGUC-5' (SEQ ID NO: 323)
MCL1-661 Target: 5'-GAGGAGGAGGACGAGTTGTACCGGCAG-3' (SEQ ID NO: 638)

5'-CGGCAGUCGCUGGAGAUUAUCUCUC-3'   (SEQ ID NO: 954)
                 3'-UGGCCGUCAGCGACCUCUAAUAGAGAG-5' (SEQ ID NO: 324)
MCL1-680 Target: 5'-ACCGGCAGTCGCTGGAGATTATCTCTC-3' (SEQ ID NO: 639)
```

TABLE 3-continued

Selected Human Anti-MCL1 DsiRNAs, Unmodified Duplexes (Asymmetrics)

| | | |
|---|---|---|
| MCL1-733 Target: | 5'-CAAGGACACAAAGCCAAUGGGCAGG-3'<br>3'-CGGUUCCUGUGUUUCGGUUACCCGUCC-5'<br>5'-GCCAAGGACACAAAGCCAATGGGCAGG-3' | (SEQ ID NO: 955)<br>(SEQ ID NO: 325)<br>(SEQ ID NO: 640) |
| MCL1-774 Target: | 5'-GGAAGGCGCUGGAGACCUUACGACG-3'<br>3'-GUCCUUCCGCGACCUCUGGAAUGCUGC-5'<br>5'-CAGGAAGGCGCTGGAGACCTTACGACG-3' | (SEQ ID NO: 956)<br>(SEQ ID NO: 326)<br>(SEQ ID NO: 641) |
| MCL1-809 Target: | 5'-GGCGUGCAGCGCAACCACGAGACGG-3'<br>3'-UACCGCACGUCGCGUUGGUGCUCUGCC-5'<br>5'-ATGGCGTGCAGCGCAACCACGAGACGG-3' | (SEQ ID NO: 957)<br>(SEQ ID NO: 327)<br>(SEQ ID NO: 642) |
| MCL1-810 Target: | 5'-GCGUGCAGCGCAACCACGAGACGGC-3'<br>3'-ACCGCACGUCGCGUUGGUGCUCUGCCG-5'<br>5'-TGGCGTGCAGCGCAACCACGAGACGGC-3' | (SEQ ID NO: 958)<br>(SEQ ID NO: 328)<br>(SEQ ID NO: 643) |
| MCL1-811 Target: | 5'-CGUGCAGCGCAACCACGAGACGGCC-3'<br>3'-CCGCACGUCGCGUUGGUGCUCUGCCGG-5'<br>5'-GGCGTGCAGCGCAACCACGAGACGGCC-3' | (SEQ ID NO: 959)<br>(SEQ ID NO: 329)<br>(SEQ ID NO: 644) |
| MCL1-812 Target: | 5'-GUGCAGCGCAACCACGAGACGGCCU-3'<br>3'-CGCACGUCGCGUUGGUGCUCUGCCGGA-5'<br>5'-GCGTGCAGCGCAACCACGAGACGGCCT-3' | (SEQ ID NO: 960)<br>(SEQ ID NO: 330)<br>(SEQ ID NO: 645) |
| MCL1-813 Target: | 5'-UGCAGCGCAACCACGAGACGGCCUU-3'<br>3'-GCACGUCGCGUUGGUGCUCUGCCGGAA-5'<br>5'-CGTGCAGCGCAACCACGAGACGGCCTT-3' | (SEQ ID NO: 961)<br>(SEQ ID NO: 331)<br>(SEQ ID NO: 646) |
| MCL1-814 Target: | 5'-GCAGCGCAACCACGAGACGGCCUUC-3'<br>3'-CACGUCGCGUUGGUGCUCUGCCGGAAG-5'<br>5'-GTGCAGCGCAACCACGAGACGGCCTTC-3' | (SEQ ID NO: 962)<br>(SEQ ID NO: 332)<br>(SEQ ID NO: 647) |
| MCL1-815 Target: | 5'-CAGCGCAACCACGAGACGGCCUUCC-3'<br>3'-ACGUCGCGUUGGUGCUCUGCCGGAAGG-5'<br>5'-TGCAGCGCAACCACGAGACGGCCTTCC-3' | (SEQ ID NO: 963)<br>(SEQ ID NO: 333)<br>(SEQ ID NO: 648) |
| MCL1-816 Target: | 5'-AGCGCAACCACGAGACGGCCUUCCA-3'<br>3'-CGUCGCGUUGGUGCUCUGCCGGAAGGU-5'<br>5'-GCAGCGCAACCACGAGACGGCCTTCCA-3' | (SEQ ID NO: 964)<br>(SEQ ID NO: 334)<br>(SEQ ID NO: 649) |
| MCL1-817 Target: | 5'-GCGCAACCACGAGACGGCCUUCCAA-3'<br>3'-GUCGCGUUGGUGCUCUGCCGGAAGGUU-5'<br>5'-CAGCGCAACCACGAGACGGCCTTCCAA-3' | (SEQ ID NO: 965)<br>(SEQ ID NO: 335)<br>(SEQ ID NO: 650) |
| MCL1-818 Target: | 5'-CGCAACCACGAGACGGCCUUCCAAG-3'<br>3'-UCGCGUUGGUGCUCUGCCGGAAGGUUC-5'<br>5'-AGCGCAACCACGAGACGGCCTTCCAAG-3' | (SEQ ID NO: 966)<br>(SEQ ID NO: 336)<br>(SEQ ID NO: 651) |
| MCL1-819 Target: | 5'-GCAACCACGAGACGGCCUUCCAAGG-3'<br>3'-CGCGUUGGUGCUCUGCCGGAAGGUUCC-5'<br>5'-GCGCAACCACGAGACGGCCTTCCAAGG-3' | (SEQ ID NO: 967)<br>(SEQ ID NO: 337)<br>(SEQ ID NO: 652) |
| MCL1-820 Target: | 5'-CAACCACGAGACGGCCUUCCAAGGC-3'<br>3'-GCGUUGGUGCUCUGCCGGAAGGUUCCG-5'<br>5'-CGCAACCACGAGACGGCCTTCCAAGGC-3' | (SEQ ID NO: 968)<br>(SEQ ID NO: 338)<br>(SEQ ID NO: 653) |
| MCL1-821 Target: | 5'-AACCACGAGACGGCCUUCCAAGGCA-3'<br>3'-CGUUGGUGCUCUGCCGGAAGGUUCCGU-5'<br>5'-GCAACCACGAGACGGCCTTCCAAGGCA-3' | (SEQ ID NO: 969)<br>(SEQ ID NO: 339)<br>(SEQ ID NO: 654) |
| MCL1-822 Target: | 5'-ACCACGAGACGGCCUUCCAAGGCAU-3'<br>3'-GUUGGUGCUCUGCCGGAAGGUUCCGUA-5'<br>5'-CAACCACGAGACGGCCTTCCAAGGCAT-3' | (SEQ ID NO: 970)<br>(SEQ ID NO: 340)<br>(SEQ ID NO: 655) |
| MCL1-838 Target: | 5'-CCAAGGCAUGCUUCGGAAACUGGAC-3'<br>3'-AAGGUUCCGUACGAAGCCUUUGACCUG-5'<br>5'-TTCCAAGGCATGCTTCGGAAACTGGAC-3' | (SEQ ID NO: 971)<br>(SEQ ID NO: 341)<br>(SEQ ID NO: 656) |
| MCL1-839 Target: | 5'-CAAGGCAUGCUUCGGAAACUGGACA-3'<br>3'-AGGUUCCGUACGAAGCCUUUGACCUGU-5'<br>5'-TCCAAGGCATGCTTCGGAAACTGGACA-3' | (SEQ ID NO: 972)<br>(SEQ ID NO: 342)<br>(SEQ ID NO: 657) |
| MCL1-871 Target: | 5'-CGAAGACGAUGUGAAAUCGUUGUCU-3'<br>3'-UUGCUUCUGCUACACUUUAGCAACAGA-5'<br>5'-AACGAAGACGATGTGAAATCGTTGTCT-3' | (SEQ ID NO: 973)<br>(SEQ ID NO: 343)<br>(SEQ ID NO: 658) |

TABLE 3-continued

Selected Human Anti-MCL1 DsiRNAs, Unmodified Duplexes (Asymmetrics)

| | | |
|---|---|---|
| | 5'-CGAUGUGAAAUCGUUGUCUCGAGUG-3' | (SEQ ID NO: 974) |
| | 3'-CUGCUACACUUUAGCAACAGAGCUCAC-5' | (SEQ ID NO: 344) |
| MCL1-877 Target: | 5'-GACGATGTGAAATCGTTGTCTCGAGTG-3' | (SEQ ID NO: 659) |
| | 5'-GCAGGAUUGUGACUCUCAUUUCUUU-3' | (SEQ ID NO: 975) |
| | 3'-CCCGUCCUAACACUGAGAGUAAAGAAA-5' | (SEQ ID NO: 345) |
| MCL1-939 Target: | 5'-GGGCAGGATTGTGACTCTCATTTCTTT-3' | (SEQ ID NO: 660) |
| | 5'-GUGACUCUCAUUUCUUUUGGUGCCU-3' | (SEQ ID NO: 976) |
| | 3'-AACACUGAGAGUAAAGAAAACCACGGA-5' | (SEQ ID NO: 346) |
| MCL1-947 Target: | 5'-TTGTGACTCTCATTTCTTTTGGTGCCT-3' | (SEQ ID NO: 661) |
| | 5'-CUUUGUGGCUAAACACUUGAAGACC-3' | (SEQ ID NO: 977) |
| | 3'-CGGAAACACCGAUUUGUGAACUUCUGG-5' | (SEQ ID NO: 347) |
| MCL1-970 Target: | 5'-GCCTTTGTGGCTAAACACTTGAAGACC-3' | (SEQ ID NO: 662) |
| | 5'-UGGCUAAACACUUGAAGACCAUAAA-3' | (SEQ ID NO: 978) |
| | 3'-ACACCGAUUUGUGAACUUCUGGUAUUU-5' | (SEQ ID NO: 348) |
| MCL1-975 Target: | 5'-TGTGGCTAAACACTTGAAGACCATAAA-3' | (SEQ ID NO: 663) |
| | 5'-GGCUAAACACUUGAAGACCAUAAAC-3' | (SEQ ID NO: 979) |
| | 3'-CACCGAUUUGUGAACUUCUGGUAUUUG-5' | (SEQ ID NO: 349) |
| MCL1-976 Target: | 5'-GTGGCTAAACACTTGAAGACCATAAAC-3' | (SEQ ID NO: 664) |
| | 5'-GCUAAACACUUGAAGACCAUAAACC-3' | (SEQ ID NO: 980) |
| | 3'-ACCGAUUUGUGAACUUCUGGUAUUUGG-5' | (SEQ ID NO: 350) |
| MCL1-977 Target: | 5'-TGGCTAAACACTTGAAGACCATAAACC-3' | (SEQ ID NO: 665) |
| | 5'-CUAAACACUUGAAGACCAUAAACCA-3' | (SEQ ID NO: 981) |
| | 3'-CCGAUUUGUGAACUUCUGGUAUUUGGU-5' | (SEQ ID NO: 351) |
| MCL1-978 Target: | 5'-GGCTAAACACTTGAAGACCATAAACCA-3' | (SEQ ID NO: 666) |
| | 5'-ACUUGAAGACCAUAAACCAAGAAAG-3' | (SEQ ID NO: 982) |
| | 3'-UGUGAACUUCUGGUAUUUGGUUCUUUC-5' | (SEQ ID NO: 352) |
| MCL1-984 Target: | 5'-ACACTTGAAGACCATAAACCAAGAAAG-3' | (SEQ ID NO: 667) |
| | 5'-CUUGAAGACCAUAAACCAAGAAAGC-3' | (SEQ ID NO: 983) |
| | 3'-GUGAACUUCUGGUAUUUGGUUCUUUCG-5' | (SEQ ID NO: 353) |
| MCL1-985 Target: | 5'-CACTTGAAGACCATAAACCAAGAAAGC-3' | (SEQ ID NO: 668) |
| | 5'-AGACCAUAAACCAAGAAAGCUGCAU-3' | (SEQ ID NO: 984) |
| | 3'-CUUCUGGUAUUUGGUUCUUUCGACGUA-5' | (SEQ ID NO: 354) |
| MCL1-990 Target: | 5'-GAAGACCATAAACCAAGAAAGCTGCAT-3' | (SEQ ID NO: 669) |
| | 5'-CAUCGAACCAUUAGCAGAAAGUAUC-3' | (SEQ ID NO: 985) |
| | 3'-ACGUAGCUUGGUAAUCGUCUUUCAUAG-5' | (SEQ ID NO: 355) |
| MCL1-1012 Target: | 5'-TGCATCGAACCATTAGCAGAAAGTATC-3' | (SEQ ID NO: 670) |
| | 5'-AUCGAACCAUUAGCAGAAAGUAUCA-3' | (SEQ ID NO: 986) |
| | 3'-CGUAGCUUGGUAAUCGUCUUUCAUAGU-5' | (SEQ ID NO: 356) |
| MCL1-1013 Target: | 5'-GCATCGAACCATTAGCAGAAAGTATCA-3' | (SEQ ID NO: 671) |
| | 5'-ACCAUUAGCAGAAAGUAUCACAGAC-3' | (SEQ ID NO: 987) |
| | 3'-CUUGGUAAUCGUCUUUCAUAGUGUCUG-5' | (SEQ ID NO: 357) |
| MCL1-1018 Target: | 5'-GAACCATTAGCAGAAAGTATCACAGAC-3' | (SEQ ID NO: 672) |
| | 5'-GGGACUGGCUAGUUAAACAAAGAGG-3' | (SEQ ID NO: 988) |
| | 3'-UGCCCUGACCGAUCAAUUUGUUUCUCC-5' | (SEQ ID NO: 358) |
| MCL1-1062 Target: | 5'-ACGGGACTGGCTAGTTAAACAAAGAGG-3' | (SEQ ID NO: 673) |
| | 5'-GGACUGGCUAGUUAAACAAAGAGGC-3' | (SEQ ID NO: 989) |
| | 3'-GCCCUGACCGAUCAAUUUGUUUCUCCG-5' | (SEQ ID NO: 359) |
| MCL1-1063 Target: | 5'-CGGGACTGGCTAGTTAAACAAAGAGGC-3' | (SEQ ID NO: 674) |
| | 5'-CUAGUUAAACAAAGAGGCUGGGAUG-3' | (SEQ ID NO: 990) |
| | 3'-CCGAUCAAUUUGUUUCUCCGACCCUAC-5' | (SEQ ID NO: 360) |
| MCL1-1070 Target: | 5'-GGCTAGTTAAACAAAGAGGCTGGGATG-3' | (SEQ ID NO: 675) |
| | 5'-AAACAAAGAGGCUGGGAUGGGUUUG-3' | (SEQ ID NO: 991) |
| | 3'-AAUUUGUUUCUCCGACCCUACCCAAAC-5' | (SEQ ID NO: 361) |
| MCL1-1076 Target: | 5'-TTAAACAAAGAGGCTGGGATGGGTTTG-3' | (SEQ ID NO: 676) |
| | 5'-AACAAAGAGGCUGGGAUGGGUUUGU-3' | (SEQ ID NO: 992) |
| | 3'-AUUUGUUUCUCCGACCCUACCCAAACA-5' | (SEQ ID NO: 362) |
| MCL1-1077 Target: | 5'-TAAACAAAGAGGCTGGGATGGGTTTGT-3' | (SEQ ID NO: 677) |

TABLE 3-continued

Selected Human Anti-MCL1 DsiRNAs, Unmodified Duplexes (Asymmetrics)

| | | |
|---|---|---|
| MCL1-1078 | 5'-ACAAAGAGGCUGGGAUGGGUUUGUG-3'<br>3'-UUUGUUUCUCCGACCCUACCCAAACAC-5'<br>Target: 5'-AAACAAAGAGGCTGGGATGGGTTTGTG-3' | (SEQ ID NO: 993)<br>(SEQ ID NO: 363)<br>(SEQ ID NO: 678) |
| MCL1-1079 | 5'-CAAAGAGGCUGGGAUGGGUUUGUGG-3'<br>3'-UUGUUUCUCCGACCCUACCCAAACACC-5'<br>Target: 5'-AACAAAGAGGCTGGGATGGGTTTGTGG-3' | (SEQ ID NO: 994)<br>(SEQ ID NO: 364)<br>(SEQ ID NO: 679) |
| MCL1-1080 | 5'-AAAGAGGCUGGGAUGGGUUUGUGGA-3'<br>3'-UGUUUCUCCGACCCUACCCAAACACCU-5'<br>Target: 5'-ACAAAGAGGCTGGGATGGGTTTGTGGA-3' | (SEQ ID NO: 995)<br>(SEQ ID NO: 365)<br>(SEQ ID NO: 680) |
| MCL1-1081 | 5'-AAGAGGCUGGGAUGGGUUUGUGGAG-3'<br>3'-GUUUCUCCGACCCUACCCAAACACCUC-5'<br>Target: 5'-CAAAGAGGCTGGGATGGGTTTGTGGAG-3' | (SEQ ID NO: 996)<br>(SEQ ID NO: 366)<br>(SEQ ID NO: 681) |
| MCL1-1082 | 5'-AGAGGCUGGGAUGGGUUUGUGGAGU-3'<br>3'-UUUCUCCGACCCUACCCAAACACCUCA-5'<br>Target: 5'-AAAGAGGCTGGGATGGGTTTGTGGAGT-3' | (SEQ ID NO: 997)<br>(SEQ ID NO: 367)<br>(SEQ ID NO: 682) |
| MCL1-1083 | 5'-GAGGCUGGGAUGGGUUUGUGGAGUU-3'<br>3'-UUCUCCGACCCUACCCAAACACCUCAA-5'<br>Target: 5'-AAGAGGCTGGGATGGGTTTGTGGAGTT-3' | (SEQ ID NO: 998)<br>(SEQ ID NO: 368)<br>(SEQ ID NO: 683) |
| MCL1-1084 | 5'-AGGCUGGGAUGGGUUUGUGGAGUUC-3'<br>3'-UCUCCGACCCUACCCAAACACCUCAAG-5'<br>Target: 5'-AGAGGCTGGGATGGGTTTGTGGAGTTC-3' | (SEQ ID NO: 999)<br>(SEQ ID NO: 369)<br>(SEQ ID NO: 684) |
| MCL1-1085 | 5'-GGCUGGGAUGGGUUUGUGGAGUUCU-3'<br>3'-CUCCGACCCUACCCAAACACCUCAAGA-5'<br>Target: 5'-GAGGCTGGGATGGGTTTGTGGAGTTCT-3' | (SEQ ID NO: 1000)<br>(SEQ ID NO: 370)<br>(SEQ ID NO: 685) |
| MCL1-1086 | 5'-GCUGGGAUGGGUUUGUGGAGUUCUU-3'<br>3'-UCCGACCCUACCCAAACACCUCAAGAA-5'<br>Target: 5'-AGGCTGGGATGGGTTTGTGGAGTTCTT-3' | (SEQ ID NO: 1001)<br>(SEQ ID NO: 371)<br>(SEQ ID NO: 686) |
| MCL1-1087 | 5'-CUGGGAUGGGUUUGUGGAGUUCUUC-3'<br>3'-CCGACCCUACCCAAACACCUCAAGAAG-5'<br>Target: 5'-GGCTGGGATGGGTTTGTGGAGTTCTTC-3' | (SEQ ID NO: 1002)<br>(SEQ ID NO: 372)<br>(SEQ ID NO: 687) |
| MCL1-1088 | 5'-UGGGAUGGGUUUGUGGAGUUCUUCC-3'<br>3'-CGACCCUACCCAAACACCUCAAGAAGG-5'<br>Target: 5'-GCTGGGATGGGTTTGTGGAGTTCTTCC-3' | (SEQ ID NO: 1003)<br>(SEQ ID NO: 373)<br>(SEQ ID NO: 688) |
| MCL1-1089 | 5'-GGGAUGGGUUUGUGGAGUUCUUCCA-3'<br>3'-GACCCUACCCAAACACCUCAAGAAGGU-5'<br>Target: 5'-CTGGGATGGGTTTGTGGAGTTCTTCCA-3' | (SEQ ID NO: 1004)<br>(SEQ ID NO: 374)<br>(SEQ ID NO: 689) |
| MCL1-1090 | 5'-GGAUGGGUUUGUGGAGUUCUUCCAU-3'<br>3'-ACCCUACCCAAACACCUCAAGAAGGUA-5'<br>Target: 5'-TGGGATGGGTTTGTGGAGTTCTTCCAT-3' | (SEQ ID NO: 1005)<br>(SEQ ID NO: 375)<br>(SEQ ID NO: 690) |
| MCL1-1091 | 5'-GAUGGGUUUGUGGAGUUCUUCCAUG-3'<br>3'-CCCUACCCAAACACCUCAAGAAGGUAC-5'<br>Target: 5'-GGGATGGGTTTGTGGAGTTCTTCCATG-3' | (SEQ ID NO: 1006)<br>(SEQ ID NO: 376)<br>(SEQ ID NO: 691) |
| MCL1-1092 | 5'-AUGGGUUUGUGGAGUUCUUCCAUGU-3'<br>3'-CCUACCCAAACACCUCAAGAAGGUACA-5'<br>Target: 5'-GGATGGGTTTGTGGAGTTCTTCCATGT-3' | (SEQ ID NO: 1007)<br>(SEQ ID NO: 377)<br>(SEQ ID NO: 692) |
| MCL1-1093 | 5'-UGGGUUUGUGGAGUUCUUCCAUGUA-3'<br>3'-CUACCCAAACACCUCAAGAAGGUACAU-5'<br>Target: 5'-GATGGGTTTGTGGAGTTCTTCCATGTA-3' | (SEQ ID NO: 1008)<br>(SEQ ID NO: 378)<br>(SEQ ID NO: 693) |
| MCL1-1094 | 5'-GGGUUUGUGGAGUUCUUCCAUGUAG-3'<br>3'-UACCCAAACACCUCAAGAAGGUACAUC-5'<br>Target: 5'-ATGGGTTTGTGGAGTTCTTCCATGTAG-3' | (SEQ ID NO: 1009)<br>(SEQ ID NO: 379)<br>(SEQ ID NO: 694) |
| MCL1-1095 | 5'-GGUUUGUGGAGUUCUUCCAUGUAGA-3'<br>3'-ACCCAAACACCUCAAGAAGGUACAUCU-5'<br>Target: 5'-TGGGTTTGTGGAGTTCTTCCATGTAGA-3' | (SEQ ID NO: 1010)<br>(SEQ ID NO: 380)<br>(SEQ ID NO: 695) |
| MCL1-1104 | 5'-AGUUCUUCCAUGUAGAGGACCUAGA-3'<br>3'-CCUCAAGAAGGUACAUCUCCUGGAUCU-5'<br>Target: 5'-GGAGTTCTTCCATGTAGAGGACCTAGA-3' | (SEQ ID NO: 1011)<br>(SEQ ID NO: 381)<br>(SEQ ID NO: 696) |

TABLE 3-continued

Selected Human Anti-MCL1 DsiRNAs, Unmodified Duplexes (Asymmetrics)

| | | |
|---|---|---|
| MCL1-1111 Target: | 5'-CCAUGUAGAGGACCUAGAAGGUGGC-3'<br>3'-AAGGUACAUCUCCUGGAUCUUCCACCG-5'<br>5'-TTCCATGTAGAGGACCTAGAAGGTGGC-3' | (SEQ ID NO: 1012)<br>(SEQ ID NO: 382)<br>(SEQ ID NO: 697) |
| MCL1-1120 Target: | 5'-GGACCUAGAAGGUGGCAUCAGGAAU-3'<br>3'-CUCCUGGAUCUUCCACCGUAGUCCUUA-5'<br>5'-GAGGACCTAGAAGGTGGCATCAGGAAT-3' | (SEQ ID NO: 1013)<br>(SEQ ID NO: 383)<br>(SEQ ID NO: 698) |
| MCL1-1163 Target: | 5'-GGUGUUGCUGGAGUAGGAGCUGGUU-3'<br>3'-GUCCACAACGACCUCAUCCUCGACCAA-5'<br>5'-CAGGTGTTGCTGGAGTAGGAGCTGGTT-3' | (SEQ ID NO: 1014)<br>(SEQ ID NO: 384)<br>(SEQ ID NO: 699) |
| MCL1-1182 Target: | 5'-CUGGUUUGGCAUAUCUAAUAAGAUA-3'<br>3'-UCGACCAAACCGUAUAGAUUAUUCUAU-5'<br>5'-AGCTGGTTTGGCATATCTAATAAGATA-3' | (SEQ ID NO: 1015)<br>(SEQ ID NO: 385)<br>(SEQ ID NO: 700) |
| MCL1-1188 Target: | 5'-UGGCAUAUCUAAUAAGAUAGCCUUA-3'<br>3'-AAACCGUAUAGAUUAUUCUAUCGGAAU-5'<br>5'-TTTGGCATATCTAATAAGATAGCCTTA-3' | (SEQ ID NO: 1016)<br>(SEQ ID NO: 386)<br>(SEQ ID NO: 701) |
| MCL1-1189 Target: | 5'-GGCAUAUCUAAUAAGAUAGCCUUAC-3'<br>3'-AACCGUAUAGAUUAUUCUAUCGGAAUG-5'<br>5'-TTGGCATATCTAATAAGATAGCCTTAC-3' | (SEQ ID NO: 1017)<br>(SEQ ID NO: 387)<br>(SEQ ID NO: 702) |
| MCL1-1190 Target: | 5'-GCAUAUCUAAUAAGAUAGCCUUACU-3'<br>3'-ACCGUAUAGAUUAUUCUAUCGGAAUGA-5'<br>5'-TGGCATATCTAATAAGATAGCCTTACT-3' | (SEQ ID NO: 1018)<br>(SEQ ID NO: 388)<br>(SEQ ID NO: 703) |
| MCL1-1191 Target: | 5'-CAUAUCUAAUAAGAUAGCCUUACUG-3'<br>3'-CCGUAUAGAUUAUUCUAUCGGAAUGAC-5'<br>5'-GGCATATCTAATAAGATAGCCTTACTG-3' | (SEQ ID NO: 1019)<br>(SEQ ID NO: 389)<br>(SEQ ID NO: 704) |
| MCL1-1192 Target: | 5'-AUAUCUAAUAAGAUAGCCUUACUGU-3'<br>3'-CGUAUAGAUUAUUCUAUCGGAAUGACA-5'<br>5'-GCATATCTAATAAGATAGCCTTACTGT-3' | (SEQ ID NO: 1020)<br>(SEQ ID NO: 390)<br>(SEQ ID NO: 705) |
| MCL1-1193 Target: | 5'-UAUCUAAUAAGAUAGCCUUACUGUA-3'<br>3'-GUAUAGAUUAUUCUAUCGGAAUGACAU-5'<br>5'-CATATCTAATAAGATAGCCTTACTGTA-3' | (SEQ ID NO: 1021)<br>(SEQ ID NO: 391)<br>(SEQ ID NO: 706) |
| MCL1-1207 Target: | 5'-GCCUUACUGUAAGUGCAAUAGUUGA-3'<br>3'-AUCGGAAUGACAUUCACGUUAUCAACU-5'<br>5'-TAGCCTTACTGTAAGTGCAATAGTTGA-3' | (SEQ ID NO: 1022)<br>(SEQ ID NO: 392)<br>(SEQ ID NO: 707) |
| MCL1-1276 Target: | 5'-GGACUCCAAGCUGUAACUUCCUAGA-3'<br>3'-AACCUGAGGUUCGACAUUGAAGGAUCU-5'<br>5'-TTGGACTCCAAGCTGTAACTTCCTAGA-3' | (SEQ ID NO: 1023)<br>(SEQ ID NO: 393)<br>(SEQ ID NO: 708) |
| MCL1-1293 Target: | 5'-UUCCUAGAGUUGCACCCUAGCAACC-3'<br>3'-UGAAGGAUCUCAACGUGGGAUCGUUGG-5'<br>5'-ACTTCCTAGAGTTGCACCCTAGCAACC-3' | (SEQ ID NO: 1024)<br>(SEQ ID NO: 394)<br>(SEQ ID NO: 709) |
| MCL1-1329 Target: | 5'-GCAAGUGGCAAGAGGAUUAUGGCUA-3'<br>3'-UUCGUUCACCGUUCUCCUAAUACCGAU-5'<br>5'-AAGCAAGTGGCAAGAGGATTATGGCTA-3' | (SEQ ID NO: 1025)<br>(SEQ ID NO: 395)<br>(SEQ ID NO: 710) |
| MCL1-1334 Target: | 5'-UGGCAAGAGGAUUAUGGCUAACAAG-3'<br>3'-UCACCGUUCUCCUAAUACCGAUUGUUC-5'<br>5'-AGTGGCAAGAGGATTATGGCTAACAAG-3' | (SEQ ID NO: 1026)<br>(SEQ ID NO: 396)<br>(SEQ ID NO: 711) |
| MCL1-1335 Target: | 5'-GGCAAGAGGAUUAUGGCUAACAAGA-3'<br>3'-CACCGUUCUCCUAAUACCGAUUGUUCU-5'<br>5'-GTGGCAAGAGGATTATGGCTAACAAGA-3' | (SEQ ID NO: 1027)<br>(SEQ ID NO: 397)<br>(SEQ ID NO: 712) |
| MCL1-1340 Target: | 5'-GAGGAUUAUGGCUAACAAGAAUAAA-3'<br>3'-UUCUCCUAAUACCGAUUGUUCUUAUUU-5'<br>5'-AAGAGGATTATGGCTAACAAGAATAAA-3' | (SEQ ID NO: 1028)<br>(SEQ ID NO: 398)<br>(SEQ ID NO: 713) |
| MCL1-1348 Target: | 5'-UGGCUAACAAGAAUAAAUACAUGGG-3'<br>3'-AUACCGAUUGUUCUUAUUUAUGUACCC-5'<br>5'-TATGGCTAACAAGAATAAATACATGGG-3' | (SEQ ID NO: 1029)<br>(SEQ ID NO: 399)<br>(SEQ ID NO: 714) |
| MCL1-1349 Target: | 5'-GGCUAACAAGAAUAAAUACAUGGGA-3'<br>3'-UACCGAUUGUUCUUAUUUAUGUACCCU-5'<br>5'-ATGGCTAACAAGAATAAATACATGGGA-3' | (SEQ ID NO: 1030)<br>(SEQ ID NO: 400)<br>(SEQ ID NO: 715) |

TABLE 3-continued

Selected Human Anti-MCL1 DsiRNAs, Unmodified Duplexes (Asymmetrics)

| | | |
|---|---|---|
| | 5'-GCUAACAAGAAUAAAUACAUGGGAA-3' | (SEQ ID NO: 1031) |
| | 3'-ACCGAUUGUUCUUAUUUAUGUACCCUU-5' | (SEQ ID NO: 401) |
| MCL1-1350 Target: | 5'-TGGCTAACAAGAATAAATACATGGGAA-3' | (SEQ ID NO: 716) |
| | 5'-CUAACAAGAAUAAAUACAUGGGAAG-3' | (SEQ ID NO: 1032) |
| | 3'-CCGAUUGUUCUUAUUUAUGUACCCUUC-5' | (SEQ ID NO: 402) |
| MCL1-1351 Target: | 5'-GGCTAACAAGAATAAATACATGGGAAG-3' | (SEQ ID NO: 717) |
| | 5'-UAACAAGAAUAAAUACAUGGGAAGA-3' | (SEQ ID NO: 1033) |
| | 3'-CGAUUGUUCUUAUUUAUGUACCCUUCU-5' | (SEQ ID NO: 403) |
| MCL1-1352 Target: | 5'-GCTAACAAGAATAAATACATGGGAAGA-3' | (SEQ ID NO: 718) |
| | 5'-AACAAGAAUAAAUACAUGGGAAGAG-3' | (SEQ ID NO: 1034) |
| | 3'-GAUUGUUCUUAUUUAUGUACCCUUCUC-5' | (SEQ ID NO: 404) |
| MCL1-1353 Target: | 5'-CTAACAAGAATAAATACATGGGAAGAG-3' | (SEQ ID NO: 719) |
| | 5'-ACAAGAAUAAAUACAUGGGAAGAGU-3' | (SEQ ID NO: 1035) |
| | 3'-AUUGUUCUUAUUUAUGUACCCUUCUCA-5' | (SEQ ID NO: 405) |
| MCL1-1354 Target: | 5'-TAACAAGAATAAATACATGGGAAGAGT-3' | (SEQ ID NO: 720) |
| | 5'-CAAGAAUAAAUACAUGGGAAGAGUG-3' | (SEQ ID NO: 1036) |
| | 3'-UUGUUCUUAUUUAUGUACCCUUCUCAC-5' | (SEQ ID NO: 406) |
| MCL1-1355 Target: | 5'-AACAAGAATAAATACATGGGAAGAGTG-3' | (SEQ ID NO: 721) |
| | 5'-AAGAAUAAAUACAUGGGAAGAGUGC-3' | (SEQ ID NO: 1037) |
| | 3'-UGUUCUUAUUUAUGUACCCUUCUCACG-5' | (SEQ ID NO: 407) |
| MCL1-1356 Target: | 5'-ACAAGAATAAATACATGGGAAGAGTGC-3' | (SEQ ID NO: 722) |
| | 5'-AGAAUAAAUACAUGGGAAGAGUGCU-3' | (SEQ ID NO: 1038) |
| | 3'-GUUCUUAUUUAUGUACCCUUCUCACGA-5' | (SEQ ID NO: 408) |
| MCL1-1357 Target: | 5'-CAAGAATAAATACATGGGAAGAGTGCT-3' | (SEQ ID NO: 723) |
| | 5'-CAUUGAUUGAAGAGUCACUGUCUGA-3' | (SEQ ID NO: 1039) |
| | 3'-GGGUAACUAACUUCUCAGUGACAGACU-5' | (SEQ ID NO: 409) |
| MCL1-1385 Target: | 5'-CCCATTGATTGAAGAGTCACTGTCTGA-3' | (SEQ ID NO: 724) |
| | 5'-CUGUCUGAAAGAAGCAAAGUUCAGU-3' | (SEQ ID NO: 1040) |
| | 3'-GUGACAGACUUUCUUCGUUUCAAGUCA-5' | (SEQ ID NO: 410) |
| MCL1-1402 Target: | 5'-CACTGTCTGAAAGAAGCAAAGTTCAGT-3' | (SEQ ID NO: 725) |
| | 5'-ACAAACUUUGUUUGGGAAGCUAUGG-3' | (SEQ ID NO: 1041) |
| | 3'-UUUGUUUGAAACAAACCCUUCGAUACC-5' | (SEQ ID NO: 411) |
| MCL1-1438 Target: | 5'-AAACAAACTTTGTTTGGGAAGCTATGG-3' | (SEQ ID NO: 726) |
| | 5'-AGGACUUUUAGAUUUAGUGAAGAUG-3' | (SEQ ID NO: 1042) |
| | 3'-CCUCCUGAAAAUCUAAAUCACUUCUAC-5' | (SEQ ID NO: 412) |
| MCL1-1466 Target: | 5'-GGAGGACTTTTAGATTTAGTGAAGATG-3' | (SEQ ID NO: 727) |
| | 5'-AGAUGGUAGGGUGGAAAGACUUAAU-3' | (SEQ ID NO: 1043) |
| | 3'-CUUCUACCAUCCCACCUUUCUGAAUUA-5' | (SEQ ID NO: 413) |
| MCL1-1486 Target: | 5'-GAAGATGGTAGGGTGGAAAGACTTAAT-3' | (SEQ ID NO: 728) |
| | 5'-CUUGUUGAGAACAGGAAAGUGGCCA-3' | (SEQ ID NO: 1044) |
| | 3'-AGGAACAACUCUUGUCCUUUCACCGGU-5' | (SEQ ID NO: 414) |
| MCL1-1514 Target: | 5'-TCCTTGTTGAGAACAGGAAAGTGGCCA-3' | (SEQ ID NO: 729) |
| | 5'-GCCAGGCAAGUCAUAGAAUUGAUUA-3' | (SEQ ID NO: 1045) |
| | 3'-AUCGGUCCGUUCAGUAUCUUAACUAAU-5' | (SEQ ID NO: 415) |
| MCL1-1542 Target: | 5'-TAGCCAGGCAAGTCATAGAATTGATTA-3' | (SEQ ID NO: 730) |
| | 5'-AGGCAAGUCAUAGAAUUGAUUACCC-3' | (SEQ ID NO: 1046) |
| | 3'-GGUCCGUUCAGUAUCUUAACUAAUGGG-5' | (SEQ ID NO: 416) |
| MCL1-1545 Target: | 5'-CCAGGCAAGTCATAGAATTGATTACCC-3' | (SEQ ID NO: 731) |
| | 5'-GGCAAGUCAUAGAAUUGAUUACCCG-3' | (SEQ ID NO: 1047) |
| | 3'-GUCCGUUCAGUAUCUUAACUAAUGGGC-5' | (SEQ ID NO: 417) |
| MCL1-1546 Target: | 5'-CAGGCAAGTCATAGAATTGATTACCCG-3' | (SEQ ID NO: 732) |
| | 5'-CCCGCCGAAUUCAUUAAUUUACUGU-3' | (SEQ ID NO: 1048) |
| | 3'-AUGGGCGGCUUAAGUAAUUAAAUGACA-5' | (SEQ ID NO: 418) |
| MCL1-1567 Target: | 5'-TACCCGCCGAATTCATTAATTTACTGT-3' | (SEQ ID NO: 733) |
| | 5'-CGAAUUCAUUAAUUUACUGUAGUGU-3' | (SEQ ID NO: 1049) |
| | 3'-CGGCUUAAGUAAUUAAAUGACAUCACA-5' | (SEQ ID NO: 419) |
| MCL1-1572 Target: | 5'-GCCGAATTCATTAATTTACTGTAGTGT-3' | (SEQ ID NO: 734) |

TABLE 3-continued

Selected Human Anti-MCL1 DsiRNAs, Unmodified Duplexes (Asymmetrics)

| | | |
|---|---|---|
| MCL1-1593 | 5'-GUGUUAAGAGAAGCACUAAGAAUGC-3'<br>3'-AUCACAAUUCUCUUCGUGAUUCUUACG-5'<br>Target: 5'-TAGTGTTAAGAGAAGCACTAAGAATGC-3' | (SEQ ID NO: 1050)<br>(SEQ ID NO: 420)<br>(SEQ ID NO: 735) |
| MCL1-1604 | 5'-AGCACUAAGAAUGCCAGUGACCUGU-3'<br>3'-CUUCGUGAUUCUUACGGUCACUGGACA-5'<br>Target: 5'-GAAGCACTAAGAATGCCAGTGACCTGT-3' | (SEQ ID NO: 1051)<br>(SEQ ID NO: 421)<br>(SEQ ID NO: 736) |
| MCL1-1640 | 5'-AAGUAAUAGAACUAUGACUGUAAGC-3'<br>3'-UGUUCAUUAUCUUGAUACUGACAUUCG-5'<br>Target: 5'-ACAAGTAATAGAACTATGACTGTAAGC-3' | (SEQ ID NO: 1052)<br>(SEQ ID NO: 422)<br>(SEQ ID NO: 737) |
| MCL1-1642 | 5'-GUAAUAGAACUAUGACUGUAAGCCU-3'<br>3'-UUCAUUAUCUUGAUACUGACAUUCGGA-5'<br>Target: 5'-AAGTAATAGAACTATGACTGTAAGCCT-3' | (SEQ ID NO: 1053)<br>(SEQ ID NO: 423)<br>(SEQ ID NO: 738) |
| MCL1-1665 | 5'-CUCAGUACUGUACAAGGGAAGCUUU-3'<br>3'-CGGAGUCAUGACAUGUUCCCUUCGAAA-5'<br>Target: 5'-GCCTCAGTACTGTACAAGGGAAGCTTT-3' | (SEQ ID NO: 1054)<br>(SEQ ID NO: 424)<br>(SEQ ID NO: 739) |
| MCL1-1711 | 5'-CCAGUAUACUUCUUAGAAAGUCCAA-3'<br>3'-AGGGUCAUAUGAAGAAUCUUUCAGGUU-5'<br>Target: 5'-TCCCAGTATACTTCTTAGAAAGTCCAA-3' | (SEQ ID NO: 1055)<br>(SEQ ID NO: 425)<br>(SEQ ID NO: 740) |
| MCL1-1754 | 5'-CCUGUUAUACUUUGGCUUGGUUUCC-3'<br>3'-AUGGACAAUAUGAAACCGAACCAAAGG-5'<br>Target: 5'-TACCTGTTATACTTTGGCTTGGTTTCC-3' | (SEQ ID NO: 1056)<br>(SEQ ID NO: 426)<br>(SEQ ID NO: 741) |
| MCL1-1798 | 5'-CCUAGUUUAUCACCAAUAAUACUUG-3'<br>3'-UCGGAUCAAAUAGUGGUUAUUAUGAAC-5'<br>Target: 5'-AGCCTAGTTTATCACCAATAATACTTG-3' | (SEQ ID NO: 1057)<br>(SEQ ID NO: 427)<br>(SEQ ID NO: 742) |
| MCL1-1808 | 5'-CACCAAUAAUACUUGACGGAAGGCU-3'<br>3'-UAGUGGUUAUUAUGAACUGCCUUCCGA-5'<br>Target: 5'-ATCACCAATAATACTTGACGGAAGGCT-3' | (SEQ ID NO: 1058)<br>(SEQ ID NO: 428)<br>(SEQ ID NO: 743) |
| MCL1-1809 | 5'-ACCAAUAAUACUUGACGGAAGGCUC-3'<br>3'-AGUGGUUAUUAUGAACUGCCUUCCGAG-5'<br>Target: 5'-TCACCAATAATACTTGACGGAAGGCTC-3' | (SEQ ID NO: 1059)<br>(SEQ ID NO: 429)<br>(SEQ ID NO: 744) |
| MCL1-1810 | 5'-CCAAUAAUACUUGACGGAAGGCUCA-3'<br>3'-GUGGUUAUUAUGAACUGCCUUCCGAGU-5'<br>Target: 5'-CACCAATAATACTTGACGGAAGGCTCA-3' | (SEQ ID NO: 1060)<br>(SEQ ID NO: 430)<br>(SEQ ID NO: 745) |
| MCL1-1829 | 5'-GGCUCAGUAAUUAGUUAUGAAUAUG-3'<br>3'-UUCCGAGUCAUUAAUCAAUACUUAUAC-5'<br>Target: 5'-AAGGCTCAGTAATTAGTTATGAATATG-3' | (SEQ ID NO: 1061)<br>(SEQ ID NO: 431)<br>(SEQ ID NO: 746) |
| MCL1-1833 | 5'-CAGUAAUUAGUUAUGAAUAUGGAUA-3'<br>3'-GAGUCAUUAAUCAAUACUUAUACCUAU-5'<br>Target: 5'-CTCAGTAATTAGTTATGAATATGGATA-3' | (SEQ ID NO: 1062)<br>(SEQ ID NO: 432)<br>(SEQ ID NO: 747) |
| MCL1-1866 | 5'-UCUUAAGACAGCUUGUAAAUGUAUU-3'<br>3'-UAAGAAUUCUGUCGAACAUUUACAUAA-5'<br>Target: 5'-ATTCTTAAGACAGCTTGTAAATGTATT-3' | (SEQ ID NO: 1063)<br>(SEQ ID NO: 433)<br>(SEQ ID NO: 748) |
| MCL1-1893 | 5'-UAAAAAUUGUAUAUAUUUUUACAGA-3'<br>3'-ACAUUUUUAACAUAUAUAAAAAUGUCU-5'<br>Target: 5'-TGTAAAAATTGTATATATTTTTACAGA-3' | (SEQ ID NO: 1064)<br>(SEQ ID NO: 434)<br>(SEQ ID NO: 749) |
| MCL1-1912 | 5'-UACAGAAAGUCUAUUUCUUUGAAAC-3'<br>3'-AAAUGUCUUUCAGAUAAAGAAACUUUG-5'<br>Target: 5'-TTTACAGAAAGTCTATTTCTTTGAAAC-3' | (SEQ ID NO: 1065)<br>(SEQ ID NO: 435)<br>(SEQ ID NO: 750) |
| MCL1-1913 | 5'-ACAGAAAGUCUAUUUCUUUGAAACG-3'<br>3'-AAUGUCUUUCAGAUAAAGAAACUUUGC-5'<br>Target: 5'-TTACAGAAAGTCTATTTCTTTGAAACG-3' | (SEQ ID NO: 1066)<br>(SEQ ID NO: 436)<br>(SEQ ID NO: 751) |
| MCL1-1914 | 5'-CAGAAAGUCUAUUUCUUUGAAACGA-3'<br>3'-AUGUCUUUCAGAUAAAGAAACUUUGCU-5'<br>Target: 5'-TACAGAAAGTCTATTTCTTTGAAACGA-3' | (SEQ ID NO: 1067)<br>(SEQ ID NO: 437)<br>(SEQ ID NO: 752) |
| MCL1-1915 | 5'-AGAAAGUCUAUUUCUUUGAAACGAA-3'<br>3'-UGUCUUUCAGAUAAAGAAACUUUGCUU-5'<br>Target: 5'-ACAGAAAGTCTATTTCTTTGAAACGAA-3' | (SEQ ID NO: 1068)<br>(SEQ ID NO: 438)<br>(SEQ ID NO: 753) |

TABLE 3-continued

Selected Human Anti-MCL1 DsiRNAs, Unmodified Duplexes (Asymmetrics)

```
                5'-GAAAGUCUAUUUCUUUGAAACGAAG-3'   (SEQ ID NO: 1069)
                3'-GUCUUUCAGAUAAAGAAACUUUGCUUC-5' (SEQ ID NO: 439)
MCL1-1916 Target: 5'-CAGAAAGTCTATTTCTTTGAAACGAAG-3' (SEQ ID NO: 754)

5'-CGAAGGAAGUAUCGAAUUUACAUUA-3'   (SEQ ID NO: 1070)
                3'-UUGCUUCCUUCAUAGCUUAAAUGUAAU-5' (SEQ ID NO: 440)
MCL1-1936 Target: 5'-AACGAAGGAAGTATCGAATTTACATTA-3' (SEQ ID NO: 755)

5'-CGAAUUUACAUUAGUUUUUUUCAUA-3'   (SEQ ID NO: 1071)
                3'-UAGCUUAAAUGUAAUCAAAAAAAGUAU-5' (SEQ ID NO: 441)
MCL1-1948 Target: 5'-ATCGAATTTACATTAGTTTTTTTCATA-3' (SEQ ID NO: 756)

5'-ACUUUGCAACUUCCGUAAUUAGGAA-3'   (SEQ ID NO: 1072)
                3'-CUUGAAACGUUGAAGGCAUUAAUCCUU-5' (SEQ ID NO: 442)
MCL1-1982 Target: 5'-GAACTTTGCAACTTCCGTAATTAGGAA-3' (SEQ ID NO: 757)

5'-AGUGUAUACAGAACGAAUUGAUGUG-3'   (SEQ ID NO: 1073)
                3'-UCUCACAUAUGUCUUGCUUAACUACAC-5' (SEQ ID NO: 443)
MCL1-2057 Target: 5'-AGAGTGTATACAGAACGAATTGATGTG-3' (SEQ ID NO: 758)

5'-GGAACAAAUCUGAUAACUAUGCAGG-3'   (SEQ ID NO: 1074)
                3'-CACCUUGUUUAGACUAUUGAUACGUCC-5' (SEQ ID NO: 444)
MCL1-2107 Target: 5'-GTGGAACAAATCTGATAACTATGCAGG-3' (SEQ ID NO: 759)

5'-AUUUUCUUAUCUGAUUUUGGUAAGU-3'   (SEQ ID NO: 1075)
                3'-UUUAAAAGAAUAGACUAAAACCAUUCA-5' (SEQ ID NO: 445)
MCL1-2137 Target: 5'-AAATTTTCTTATCTGATTTTGGTAAGT-3' (SEQ ID NO: 760)

5'-GGUUUUUCUUUGAAAACCUGGGAUU-3'   (SEQ ID NO: 1076)
                3'-AUCCAAAAGAAACUUUUGGACCCUAA-5'  (SEQ ID NO: 446)
MCL1-2174 Target: 5'-TAGGTTTTTCTTTGAAAACCTGGGATT-3' (SEQ ID NO: 761)

5'-GGGAUUGAGAGGUUGAUGAAUGGAA-3'   (SEQ ID NO: 1077)
                3'-GACCCUAACUCUCCAACUACUUACCUU-5' (SEQ ID NO: 447)
MCL1-2193 Target: 5'-CTGGGATTGAGAGGTTGATGAATGGAA-3' (SEQ ID NO: 762)

5'-AGAGGUUGAUGAAUGGAAAUUCUUU-3'   (SEQ ID NO: 1078)
                3'-ACUCUCCAACUACUUACCUUUAAGAAA-5' (SEQ ID NO: 448)
MCL1-2200 Target: 5'-TGAGAGGTTGATGAATGGAAATTCTTT-3' (SEQ ID NO: 763)

5'-GUUGAUGAAUGGAAAUUCUUUCACU-3'   (SEQ ID NO: 1079)
                3'-UCCAACUACUUACCUUUAAGAAAGUGA-5' (SEQ ID NO: 449)
MCL1-2204 Target: 5'-AGGTTGATGAATGGAAATTCTTTCACT-3' (SEQ ID NO: 764)

5'-UAUGCAAGUUUUCAAUAAUUAGGUC-3'   (SEQ ID NO: 1080)
                3'-AUAUACGUUCAAAAGUUAUUAAUCCAG-5' (SEQ ID NO: 450)
MCL1-2235 Target: 5'-TATATGCAAGTTTTCAATAATTAGGTC-3' (SEQ ID NO: 765)

5'-GGUUACUGAUGACUUACAAAUAAUG-3'   (SEQ ID NO: 1081)
                3'-UUCCAAUGACUACUGAAUGUUUAUUAC-5' (SEQ ID NO: 451)
MCL1-2275 Target: 5'-AAGGTTACTGATGACTTACAAATAATG-3' (SEQ ID NO: 766)

5'-UGGGCAAUACUCAUUUGAGUUCCUU-3'   (SEQ ID NO: 1082)
                3'-UAACCCGUUAUGAGUAAACUCAAGGAA-5' (SEQ ID NO: 452)
MCL1-2309 Target: 5'-ATTGGGCAATACTCATTTGAGTTCCTT-3' (SEQ ID NO: 767)

5'-CCAUUUGACCUAAUUUAACUGGUGA-3'   (SEQ ID NO: 1083)
                3'-AAGGUAAACUGGAUUAAAUUGACCACU-5' (SEQ ID NO: 453)
MCL1-2334 Target: 5'-TTCCATTTGACCTAATTTAACTGGTGA-3' (SEQ ID NO: 768)

5'-AAAGCUUUUACUAAAAGAUUUUCAG-3'   (SEQ ID NO: 1084)
                3'-AAUUUCGAAAAUGAUUUUCUAAAAGUC-5' (SEQ ID NO: 454)
MCL1-2389 Target: 5'-TTAAAGCTTTTACTAAAAGATTTTCAG-3' (SEQ ID NO: 769)

5'-GGUGGAUGGAGAGACAUUUGAUCCC-3'   (SEQ ID NO: 1085)
                3'-GUCCACCUACCUCUCUGUAAACUAGGG-5' (SEQ ID NO: 455)
MCL1-2459 Target: 5'-CAGGTGGATGGAGAGACATTTGATCCC-3' (SEQ ID NO: 770)

5'-CUUAAUAAAUUAUAAAAUGAUGGCU-3'   (SEQ ID NO: 1086)
                3'-ACGAAUUAUUUAAUAUUUUACUACCGA-5' (SEQ ID NO: 456)
MCL1-2491 Target: 5'-TGCTTAATAAATTATAAAATGATGGCT-3' (SEQ ID NO: 771)

5'-ACCAUGGUGCUAUUAUUAGGCUUGC-3'   (SEQ ID NO: 1087)
                3'-AUUGGUACCACGAUAAUAAUCCGAACG-5' (SEQ ID NO: 457)
MCL1-2536 Target: 5'-TAACCATGGTGCTATTATTAGGCTTGC-3' (SEQ ID NO: 772)
```

TABLE 3-continued

Selected Human Anti-MCL1 DsiRNAs, Unmodified Duplexes (Asymmetrics)

```
                  5'-AGCCUAGUAUGUCAAUAAAGCAAAU-3'      (SEQ ID NO: 1088)
                  3'-AUUCGGAUCAUACAGUUAUUUCGUUUA-5'    (SEQ ID NO: 458)
MCL1-2581 Target: 5'-TAAGCCTAGTATGTCAATAAAGCAAAT-3'    (SEQ ID NO: 773)

5'-CUGUUUUGUUUCUAUUAAUGAUUCC-3'      (SEQ ID NO: 1089)
                  3'-AUGACAAAACAAAGAUAAUUACUAAGG-5'    (SEQ ID NO: 459)
MCL1-2611 Target: 5'-TACTGTTTTGTTTCTATTAATGATTCC-3'    (SEQ ID NO: 774)

5'-CUAUUAAUGAUUCCCAAACCUUGUU-3'      (SEQ ID NO: 1090)
                  3'-AAGAUAAUUACUAAGGGUUUGGAACAA-5'    (SEQ ID NO: 460)
MCL1-2622 Target: 5'-TTCTATTAATGATTCCCAAACCTTGTT-3'    (SEQ ID NO: 775)

5'-UGUUGCAAGUUUUUGCAUUGGCAUC-3'      (SEQ ID NO: 1091)
                  3'-GAACAACGUUCAAAAACGUAACCGUAG-5'    (SEQ ID NO: 461)
MCL1-2643 Target: 5'-CTTGTTGCAAGTTTTTGCATTGGCATC-3'    (SEQ ID NO: 776)

5'-GGAUUUCAGUCUUGAUGUUUGUUCU-3'      (SEQ ID NO: 1092)
                  3'-AACCUAAAGUCAGAACUACAAACAAGA-5'    (SEQ ID NO: 462)
MCL1-2671 Target: 5'-TTGGATTTCAGTCTTGATGTTTGTTCT-3'    (SEQ ID NO: 777)

5'-UCCUUGAAAUUGCUGAUUGUUCUGC-3'      (SEQ ID NO: 1093)
                  3'-GAAGGAACUUUAACGACUAACAAGACG-5'    (SEQ ID NO: 463)
MCL1-2725 Target: 5'-CTTCCTTGAAATTGCTGATTGTTCTGC-3'    (SEQ ID NO: 778)

5'-UCCCUCUACAGAUAUUUAUAUCAAU-3'      (SEQ ID NO: 1094)
                  3'-CGAGGGAGAUGUCUAUAAAUAUAGUUA-5'    (SEQ ID NO: 464)
MCL1-2750 Target: 5'-GCTCCCTCTACAGATATTTATATCAAT-3'    (SEQ ID NO: 779)

5'-ACCAAGAGUCCACAGACCUUUCAUC-3'      (SEQ ID NO: 1095)
                  3'-GGUGGUUCUCAGGUGUCUGGAAAGUAG-5'    (SEQ ID NO: 465)
MCL1-2874 Target: 5'-CCACCAAGAGTCCACAGACCTTTCATC-3'    (SEQ ID NO: 780)

5'-CCAAGAGUCCACAGACCUUUCAUCU-3'      (SEQ ID NO: 1096)
                  3'-GUGGUUCUCAGGUGUCUGGAAAGUAGA-5'    (SEQ ID NO: 466)
MCL1-2875 Target: 5'-CACCAAGAGTCCACAGACCTTTCATCT-3'    (SEQ ID NO: 781)

5'-GUCCACAGACCUUUCAUCUUUCACG-3'      (SEQ ID NO: 1097)
                  3'-CUCAGGUGUCUGGAAAGUAGAAAGUGC-5'    (SEQ ID NO: 467)
MCL1-2881 Target: 5'-GAGTCCACAGACCTTTCATCTTTCACG-3'    (SEQ ID NO: 782)

5'-UCCACAGACCUUUCAUCUUUCACGA-3'      (SEQ ID NO: 1098)
                  3'-UCAGGUGUCUGGAAAGUAGAAAGUGCU-5'    (SEQ ID NO: 468)
MCL1-2882 Target: 5'-AGTCCACAGACCTTTCATCTTTCACGA-3'    (SEQ ID NO: 783)

5'-CCACAGACCUUUCAUCUUUCACGAA-3'      (SEQ ID NO: 1099)
                  3'-CAGGUGUCUGGAAAGUAGAAAGUGCUU-5'    (SEQ ID NO: 469)
MCL1-2883 Target: 5'-GTCCACAGACCTTTCATCTTTCACGAA-3'    (SEQ ID NO: 784)

5'-CACAGACCUUUCAUCUUUCACGAAC-3'      (SEQ ID NO: 1100)
                  3'-AGGUGUCUGGAAAGUAGAAAGUGCUUG-5'    (SEQ ID NO: 470)
MCL1-2884 Target: 5'-TCCACAGACCTTTCATCTTTCACGAAC-3'    (SEQ ID NO: 785)

5'-AGACCUUUCAUCUUUCACGAACUUG-3'      (SEQ ID NO: 1101)
                  3'-UGUCUGGAAAGUAGAAAGUGCUUGAAC-5'    (SEQ ID NO: 471)
MCL1-2887 Target: 5'-ACAGACCTTTCATCTTTCACGAACTTG-3'    (SEQ ID NO: 786)

5'-CCUUUCAUCUUUCACGAACUUGAUC-3'      (SEQ ID NO: 1102)
                  3'-CUGGAAAGUAGAAAGUGCUUGAACUAG-5'    (SEQ ID NO: 472)
MCL1-2890 Target: 5'-GACCTTTCATCTTTCACGAACTTGATC-3'    (SEQ ID NO: 787)

5'-GUGACACUAACAGUCAUUGAGAGGU-3'      (SEQ ID NO: 1103)
                  3'-GACACUGUGAUUGUCAGUAACUCUCCA-5'    (SEQ ID NO: 473)
MCL1-2945 Target: 5'-CTGTGACACTAACAGTCATTGAGAGGT-3'    (SEQ ID NO: 788)

5'-CUAACAGUCAUUGAGAGGUGGGAGG-3'      (SEQ ID NO: 1104)
                  3'-GUGAUUGUCAGUAACUCUCCACCCUCC-5'    (SEQ ID NO: 474)
MCL1-2951 Target: 5'-CACTAACAGTCATTGAGAGGTGGGAGG-3'    (SEQ ID NO: 789)

5'-GGAGUAUGCUCACUUAAAUUUACAG-3'      (SEQ ID NO: 1105)
                  3'-AUCCUCAUACGAGUGAAUUUAAAUGUC-5'    (SEQ ID NO: 475)
MCL1-3114 Target: 5'-TAGGAGTATGCTCACTTAAATTTACAG-3'    (SEQ ID NO: 790)

5'-UCACUUAAAUUUACAGAAAGAGGUG-3'      (SEQ ID NO: 1106)
                  3'-CGAGUGAAUUUAAAUGUCUUUCUCCAC-5'    (SEQ ID NO: 476)
MCL1-3123 Target: 5'-GCTCACTTAAATTTACAGAAAGAGGTG-3'    (SEQ ID NO: 791)
```

TABLE 3-continued

Selected Human Anti-MCL1 DsiRNAs, Unmodified Duplexes (Asymmetrics)

| | | |
|---|---|---|
| MCL1-3126 Target: | 5'-CUUAAAUUUACAGAAAGAGGUGAGC-3'<br>3'-GUGAAUUUAAAUGUCUUUCUCCACUCG-5'<br>5'-CACTTAAATTTACAGAAAGAGGTGAGC-3' | (SEQ ID NO: 1107)<br>(SEQ ID NO: 477)<br>(SEQ ID NO: 792) |
| MCL1-3186 Target: | 5'-ACUGAAGAAAGUGUCUAUAUUGGAA-3'<br>3'-UUUGACUUCUUUCACAGAUAUAACCUU-5'<br>5'-AAACTGAAGAAAGTGTCTATATTGGAA-3' | (SEQ ID NO: 1108)<br>(SEQ ID NO: 478)<br>(SEQ ID NO: 793) |
| MCL1-3207 Target: | 5'-GGAACUAGGGUCAUUUGAAAGCUUC-3'<br>3'-AACCUUGAUCCCAGUAAACUUUCGAAG-5'<br>5'-TTGGAACTAGGGTCATTTGAAAGCTTC-3' | (SEQ ID NO: 1109)<br>(SEQ ID NO: 479)<br>(SEQ ID NO: 794) |
| MCL1-3211 Target: | 5'-CUAGGGUCAUUUGAAAGCUUCAGUC-3'<br>3'-UUGAUCCCAGUAAACUUUCGAAGUCAG-5'<br>5'-AACTAGGGTCATTTGAAAGCTTCAGTC-3' | (SEQ ID NO: 1110)<br>(SEQ ID NO: 480)<br>(SEQ ID NO: 795) |
| MCL1-3212 Target: | 5'-UAGGGUCAUUUGAAAGCUUCAGUCU-3'<br>3'-UGAUCCCAGUAAACUUUCGAAGUCAGA-5'<br>5'-ACTAGGGTCATTTGAAAGCTTCAGTCT-3' | (SEQ ID NO: 1111)<br>(SEQ ID NO: 481)<br>(SEQ ID NO: 796) |
| MCL1-3213 Target: | 5'-AGGGUCAUUUGAAAGCUUCAGUCUC-3'<br>3'-GAUCCCAGUAAACUUUCGAAGUCAGAG-5'<br>5'-CTAGGGTCATTTGAAAGCTTCAGTCTC-3' | (SEQ ID NO: 1112)<br>(SEQ ID NO: 482)<br>(SEQ ID NO: 797) |
| MCL1-3214 Target: | 5'-GGGUCAUUUGAAAGCUUCAGUCUCG-3'<br>3'-AUCCCAGUAAACUUUCGAAGUCAGAGC-5'<br>5'-TAGGGTCATTTGAAAGCTTCAGTCTCG-3' | (SEQ ID NO: 1113)<br>(SEQ ID NO: 483)<br>(SEQ ID NO: 798) |
| MCL1-3215 Target: | 5'-GGUCAUUUGAAAGCUUCAGUCUCGG-3'<br>3'-UCCCAGUAAACUUUCGAAGUCAGAGCC-5'<br>5'-AGGGTCATTTGAAAGCTTCAGTCTCGG-3' | (SEQ ID NO: 1114)<br>(SEQ ID NO: 484)<br>(SEQ ID NO: 799) |
| MCL1-3232 Target: | 5'-AGUCUCGGAACAUGACCUUUAGUCU-3'<br>3'-AGUCAGAGCCUUGUACUGGAAAUCAGA-5'<br>5'-TCAGTCTCGGAACATGACCTTTAGTCT-3' | (SEQ ID NO: 1115)<br>(SEQ ID NO: 485)<br>(SEQ ID NO: 800) |
| MCL1-3239 Target: | 5'-GAACAUGACCUUUAGUCUGUGGACU-3'<br>3'-GCCUUGUACUGGAAAUCAGACACCUGA-5'<br>5'-CGGAACATGACCTTTAGTCTGTGGACT-3' | (SEQ ID NO: 1116)<br>(SEQ ID NO: 486)<br>(SEQ ID NO: 801) |
| MCL1-3241 Target: | 5'-ACAUGACCUUUAGUCUGUGGACUCC-3'<br>3'-CUUGUACUGGAAAUCAGACACCUGAGG-5'<br>5'-GAACATGACCTTTAGTCTGTGGACTCC-3' | (SEQ ID NO: 1117)<br>(SEQ ID NO: 487)<br>(SEQ ID NO: 802) |
| MCL1-3265 Target: | 5'-CAUUUAAAAAUAGGUAUGAAUAAGA-3'<br>3'-AGGUAAAUUUUUAUCCAUACUUAUUCU-5'<br>5'-TCCATTTAAAAATAGGTATGAATAAGA-3' | (SEQ ID NO: 1118)<br>(SEQ ID NO: 488)<br>(SEQ ID NO: 803) |
| MCL1-3277 Target: | 5'-GGUAUGAAUAAGAUGACUAAGAAUG-3'<br>3'-AUCCAUACUUAUUCUACUGAUUCUUAC-5'<br>5'-TAGGTATGAATAAGATGACTAAGAATG-3' | (SEQ ID NO: 1119)<br>(SEQ ID NO: 489)<br>(SEQ ID NO: 804) |
| MCL1-3326 Target: | 5'-GCCCAUCUCAGAGCCAUAAGGUCAU-3'<br>3'-GACGGGUAGAGUCUCGGUAUUCCAGUA-5'<br>5'-CTGCCCATCTCAGAGCCATAAGGTCAT-3' | (SEQ ID NO: 1120)<br>(SEQ ID NO: 490)<br>(SEQ ID NO: 805) |
| MCL1-3370 Target: | 5'-ACCUAUGUAUUUAUCGUUCUUGAUC-3'<br>3'-AAUGGAUACAUAAAUAGCAAGAACUAG-5'<br>5'-TTACCTATGTATTTATCGTTCTTGATC-3' | (SEQ ID NO: 1121)<br>(SEQ ID NO: 491)<br>(SEQ ID NO: 806) |
| MCL1-3399 Target: | 5'-GCCGCUUAUUUAUAUCAUGUAUCUC-3'<br>3'-UUCGGCGAAUAAAUAUAGUACAUAGAG-5'<br>5'-AAGCCGCTTATTTATATCATGTATCTC-3' | (SEQ ID NO: 1122)<br>(SEQ ID NO: 492)<br>(SEQ ID NO: 807) |
| MCL1-3446 Target: | 5'-GUAGUUUUUAAUUAAUCUUAAGAUC-3'<br>3'-UACAUCAAAAAUUAAUUAGAAUUCUAG-5'<br>5'-ATGTAGTTTTTAATTAATCTTAAGATC-3' | (SEQ ID NO: 1123)<br>(SEQ ID NO: 493)<br>(SEQ ID NO: 808) |
| MCL1-3492 Target: | 5'-CCUGUCUGCCAAAUCCAGUGGAAAC-3'<br>3'-UCGGACAGACGGUUUAGGUCACCUUUG-5'<br>5'-AGCCTGTCTGCCAAATCCAGTGGAAAC-3' | (SEQ ID NO: 1124)<br>(SEQ ID NO: 494)<br>(SEQ ID NO: 809) |
| MCL1-3498 Target: | 5'-UGCCAAAUCCAGUGGAAACAAGUGC-3'<br>3'-AGACGGUUUAGGUCACCUUUGUUCACG-5'<br>5'-TCTGCCAAATCCAGTGGAAACAAGTGC-3' | (SEQ ID NO: 1125)<br>(SEQ ID NO: 495)<br>(SEQ ID NO: 810) |

TABLE 3-continued

Selected Human Anti-MCL1 DsiRNAs, Unmodified Duplexes (Asymmetrics)

| | | |
|---|---|---|
| MCL1-3508 | 5'-AGUGGAAACAAGUGCAUAGAUGUGA-3'<br>3'-GGUCACCUUUGUUCACGUAUCUACACU-5'<br>Target: 5'-CCAGTGGAAACAAGTGCATAGATGTGA-3' | (SEQ ID NO: 1126)<br>(SEQ ID NO: 496)<br>(SEQ ID NO: 811) |
| MCL1-3511 | 5'-GGAAACAAGUGCAUAGAUGUGAAUU-3'<br>3'-CACCUUUGUUCACGUAUCUACACUUAA-5'<br>Target: 5'-GTGGAAACAAGTGCATAGATGTGAATT-3' | (SEQ ID NO: 1127)<br>(SEQ ID NO: 497)<br>(SEQ ID NO: 812) |
| MCL1-3552 | 5'-ACUUCCCAAUUCAUUAGGUAUGACU-3'<br>3'-GGUGAAGGGUUAAGUAAUCCAUACUGA-5'<br>Target: 5'-CCACTTCCCAATTCATTAGGTATGACT-3' | (SEQ ID NO: 1128)<br>(SEQ ID NO: 498)<br>(SEQ ID NO: 813) |
| MCL1-3568 | 5'-GGUAUGACUGUGGAAAUACAGACAA-3'<br>3'-AUCCAUACUGACACCUUUAUGUCUGUU-5'<br>Target: 5'-TAGGTATGACTGTGGAAATACAGACAA-3' | (SEQ ID NO: 1129)<br>(SEQ ID NO: 499)<br>(SEQ ID NO: 814) |
| MCL1-3573 | 5'-GACUGUGGAAAUACAGACAAGGAUC-3'<br>3'-UACUGACACCUUUAUGUCUGUUCCUAG-5'<br>Target: 5'-ATGACTGTGGAAATACAGACAAGGATC-3' | (SEQ ID NO: 1130)<br>(SEQ ID NO: 500)<br>(SEQ ID NO: 815) |
| MCL1-3574 | 5'-ACUGUGGAAAUACAGACAAGGAUCU-3'<br>3'-ACUGACACCUUUAUGUCUGUUCCUAGA-5'<br>Target: 5'-TGACTGTGGAAATACAGACAAGGATCT-3' | (SEQ ID NO: 1131)<br>(SEQ ID NO: 501)<br>(SEQ ID NO: 816) |
| MCL1-3576 | 5'-UGUGGAAAUACAGACAAGGAUCUUA-3'<br>3'-UGACACCUUUAUGUCUGUUCCUAGAAU-5'<br>Target: 5'-ACTGTGGAAATACAGACAAGGATCTTA-3' | (SEQ ID NO: 1132)<br>(SEQ ID NO: 502)<br>(SEQ ID NO: 817) |
| MCL1-3577 | 5'-GUGGAAAUACAGACAAGGAUCUUAG-3'<br>3'-GACACCUUUAUGUCUGUUCCUAGAAUC-5'<br>Target: 5'-CTGTGGAAATACAGACAAGGATCTTAG-3' | (SEQ ID NO: 1133)<br>(SEQ ID NO: 503)<br>(SEQ ID NO: 818) |
| MCL1-3578 | 5'-UGGAAAUACAGACAAGGAUCUUAGU-3'<br>3'-ACACCUUUAUGUCUGUUCCUAGAAUCA-5'<br>Target: 5'-TGTGGAAATACAGACAAGGATCTTAGT-3' | (SEQ ID NO: 1134)<br>(SEQ ID NO: 504)<br>(SEQ ID NO: 819) |
| MCL1-3579 | 5'-GGAAAUACAGACAAGGAUCUUAGUU-3'<br>3'-CACCUUUAUGUCUGUUCCUAGAAUCAA-5'<br>Target: 5'-GTGGAAATACAGACAAGGATCTTAGTT-3' | (SEQ ID NO: 1135)<br>(SEQ ID NO: 505)<br>(SEQ ID NO: 820) |
| MCL1-3580 | 5'-GAAAUACAGACAAGGAUCUUAGUUG-3'<br>3'-ACCUUUAUGUCUGUUCCUAGAAUCAAC-5'<br>Target: 5'-TGGAAATACAGACAAGGATCTTAGTTG-3' | (SEQ ID NO: 1136)<br>(SEQ ID NO: 506)<br>(SEQ ID NO: 821) |
| MCL1-3690 | 5'-GGAGGAGGCAGGUGGUCUAAGUGCU-3'<br>3'-CUCCUCCUCCGUCCACCAGAUUCACGA-5'<br>Target: 5'-GAGGAGGAGGCAGGTGGTCTAAGTGCT-3' | (SEQ ID NO: 1137)<br>(SEQ ID NO: 507)<br>(SEQ ID NO: 822) |
| MCL1-3720 | 5'-GCUACGUAGUUCGGGCAAAUCCUCC-3'<br>3'-ACCGAUGCAUCAAGCCCGUUUAGGAGG-5'<br>Target: 5'-TGGCTACGTAGTTCGGGCAAATCCTCC-3' | (SEQ ID NO: 1138)<br>(SEQ ID NO: 508)<br>(SEQ ID NO: 823) |
| MCL1-3758 | 5'-AGGAUUUGCUUAGAAGGAUGGCGCU-3'<br>3'-CCUCCUAAACGAAUCUUCCUACCGCGA-5'<br>Target: 5'-GGAGGATTTGCTTAGAAGGATGGCGCT-3' | (SEQ ID NO: 1139)<br>(SEQ ID NO: 509)<br>(SEQ ID NO: 824) |
| MCL1-3759 | 5'-GGAUUUGCUUAGAAGGAUGGCGCUC-3'<br>3'-CUCCUAAACGAAUCUUCCUACCGCGAG-5'<br>Target: 5'-GAGGATTTGCTTAGAAGGATGGCGCTC-3' | (SEQ ID NO: 1140)<br>(SEQ ID NO: 510)<br>(SEQ ID NO: 825) |
| MCL1-3844 | 5'-CCUCUAGUGUUUCAUGUACAUUCUG-3'<br>3'-CAGGAGAUCACAAAGUACAUGUAAGAC-5'<br>Target: 5'-GTCCTCTAGTGTTTCATGTACATTCTG-3' | (SEQ ID NO: 1141)<br>(SEQ ID NO: 511)<br>(SEQ ID NO: 826) |
| MCL1-3879 | 5'-ACACCUUGGUUCUGGUUAAACAGCU-3'<br>3'-CUUGUGGAACCAAGACCAAUUUGUCGA-5'<br>Target: 5'-GAACACCTTGGTTCTGGTTAAACAGCT-3' | (SEQ ID NO: 1142)<br>(SEQ ID NO: 512)<br>(SEQ ID NO: 827) |
| MCL1-3915 | 5'-AGCUGUGCCAGGAAGGGUUAGGACC-3'<br>3'-UAUCGACACGGUCCUUCCCAAUCCUGG-5'<br>Target: 5'-ATAGCTGTGCCAGGAAGGGTTAGGACC-3' | (SEQ ID NO: 1143)<br>(SEQ ID NO: 513)<br>(SEQ ID NO: 828) |
| MCL1-3924 | 5'-AGGAAGGGUUAGGACCAACUACAAA-3'<br>3'-GGUCCUUCCCAAUCCUGGUUGAUGUUU-5'<br>Target: 5'-CCAGGAAGGGTTAGGACCAACTACAAA-3' | (SEQ ID NO: 1144)<br>(SEQ ID NO: 514)<br>(SEQ ID NO: 829) |

TABLE 3-continued

Selected Human Anti-MCL1 DsiRNAs, Unmodified Duplexes (Asymmetrics)

```
                   5'-GGUUAGGACCAACUACAAAUUAAUG-3'   (SEQ ID NO: 1145)
                   3'-UCCCAAUCCUGGUUGAUGUUUAAUUAC-5' (SEQ ID NO: 515)
MCL1-3930 Target:  5'-AGGGTTAGGACCAACTACAAATTAATG-3' (SEQ ID NO: 830)

5'-GAAGACGAUGUGAAAUCGUUGUCUC-3'   (SEQ ID NO: 2494)
                   3'-UGCUUCUGCUACACUUUAGCAACAGAG-5' (SEQ ID NO: 2302)
MCL1-872 Target:   5'-ACGAAGACGATGTGAAATCGTTGTCTC-3' (SEQ ID NO: 2398)

5'-AGGAUUGUGACUCUCAUUUCUUUUG-3'   (SEQ ID NO: 2495)
                   3'-CGUCCUAACACUGAGAGUAAAGAAAAC-5' (SEQ ID NO: 2303)
MCL1-941 Target:   5'-GCAGGATTGTGACTCTCATTTCTTTTG-3' (SEQ ID NO: 2399)

5'-GAUUGUGACUCUCAUUUCUUUUGGU-3'   (SEQ ID NO: 2496)
                   3'-UCCUAACACUGAGAGUAAAGAAAACCA-5' (SEQ ID NO: 2304)
MCL1-943 Target:   5'-AGGATTGTGACTCTCATTTCTTTTGGT-3' (SEQ ID NO: 2400)

5'-GGUGCCUUUGUGGCUAAACACUUGA-3'   (SEQ ID NO: 2497)
                   3'-AACCACGGAAACACCGAUUUGUGAACU-5' (SEQ ID NO: 2305)
MCL1-965 Target:   5'-TTGGTGCCTTTGTGGCTAAACACTTGA-3' (SEQ ID NO: 2401)

5'-GCCUUUGUGGCUAAACACUUGAAGA-3'   (SEQ ID NO: 2498)
                   3'-CACGGAAACACCGAUUUGUGAACUUCU-5' (SEQ ID NO: 2306)
MCL1-968 Target:   5'-GTGCCTTTGTGGCTAAACACTTGAAGA-3' (SEQ ID NO: 2402)

5'-GGUUUGUGGAGUUCUUCCAUGUAGA-3'   (SEQ ID NO: 2499)
                   3'-ACCCAAACACCUCAAGAAGGUACAUCU-5' (SEQ ID NO: 2307)
MCL1-1095 Target:  5'-TGGGTTTGTGGAGTTCTTCCATGTAGA-3' (SEQ ID NO: 2403)

5'-CCUAGCAACCUAGCCAGAAAAGCAA-3'   (SEQ ID NO: 2500)
                   3'-UGGGAUCGUUGGAUCGGUCUUUUCGUU-5' (SEQ ID NO: 2308)
MCL1-1308 Target:  5'-ACCCTAGCAACCTAGCCAGAAAAGCAA-3' (SEQ ID NO: 2404)

5'-GCAACCUAGCCAGAAAAGCAAGUGG-3'   (SEQ ID NO: 2501)
                   3'-AUCGUUGGAUCGGUCUUUUCGUUCACC-5' (SEQ ID NO: 2309)
MCL1-1312 Target:  5'-TAGCAACCTAGCCAGAAAAGCAAGTGG-3' (SEQ ID NO: 2405)

5'-AAAAGCAAGUGGCAAGAGGAUUAUG-3'   (SEQ ID NO: 2502)
                   3'-UCUUUUCGUUCACCGUUCUCCUAAUAC-5' (SEQ ID NO: 2310)
MCL1-1325 Target:  5'-AGAAAAGCAAGTGGCAAGAGGATTATG-3' (SEQ ID NO: 2406)

5'-AAGAGGAUUAUGGCUAACAAGAAUA-3'   (SEQ ID NO: 2503)
                   3'-CGUUCUCCUAAUACCGAUUGUUCUUAU-5' (SEQ ID NO: 2311)
MCL1-1338 Target:  5'-GCAAGAGGATTATGGCTAACAAGAATA-3' (SEQ ID NO: 2407)

5'-GGAUUAUGGCUAACAAGAAUAAAUA-3'   (SEQ ID NO: 2504)
                   3'-CUCCUAAUACCGAUUGUUCUUAUUUAU-5' (SEQ ID NO: 2312)
MCL1-1342 Target:  5'-GAGGATTATGGCTAACAAGAATAAATA-3' (SEQ ID NO: 2408)

5'-AUUAUGGCUAACAAGAAUAAAUACA-3'   (SEQ ID NO: 2505)
                   3'-CCUAAUACCGAUUGUUCUUAUUUAUGU-5' (SEQ ID NO: 2313)
MCL1-1344 Target:  5'-GGATTATGGCTAACAAGAATAAATACA-3' (SEQ ID NO: 2409)

5'-GGCUAACAAGAAUAAAUACAUGGGA-3'   (SEQ ID NO: 2506)
                   3'-UACCGAUUGUUCUUAUUUAUGUACCCU-5' (SEQ ID NO: 2314)
MCL1-1349 Target:  5'-ATGGCTAACAAGAATAAATACATGGGA-3' (SEQ ID NO: 2410)

5'-GAAGAGUCACUGUCUGAAAGAAGCA-3'   (SEQ ID NO: 2507)
                   3'-AACUUCUCAGUGACAGACUUUCUUCGU-5' (SEQ ID NO: 2315)
MCL1-1393 Target:  5'-TTGAAGAGTCACTGTCTGAAAGAAGCA-3' (SEQ ID NO: 2411)

5'-AGUCACUGUCUGAAAGAAGCAAAGU-3'   (SEQ ID NO: 2508)
                   3'-UCUCAGUGACAGACUUUCUUCGUUUCA-5' (SEQ ID NO: 2316)
MCL1-1397 Target:  5'-AGAGTCACTGTCTGAAAGAAGCAAAGT-3' (SEQ ID NO: 2412)

5'-CACUGUCUGAAAGAAGCAAAGUUCA-3'   (SEQ ID NO: 2509)
                   3'-CAGUGACAGACUUUCUUCGUUUCAAGU-5' (SEQ ID NO: 2317)
MCL1-1400 Target:  5'-GTCACTGTCTGAAAGAAGCAAAGTTCA-3' (SEQ ID NO: 2413)

5'-GUAGCCAGGCAAGUCAUAGAAUUGA-3'   (SEQ ID NO: 2510)
                   3'-GUCAUCGGUCCGUUCAGUAUCUUAACU-5' (SEQ ID NO: 2318)
MCL1-1539 Target:  5'-CAGTAGCCAGGCAAGTCATAGAATTGA-3' (SEQ ID NO: 2414)

5'-CAGGCAAGUCAUAGAAUUGAUUACC-3'   (SEQ ID NO: 2511)
                   3'-CGGUCCGUUCAGUAUCUUAACUAAUGG-5' (SEQ ID NO: 2319)
MCL1-1544 Target:  5'-GCCAGGCAAGTCATAGAATTGATTACC-3' (SEQ ID NO: 2415)
```

TABLE 3-continued

Selected Human Anti-MCL1 DsiRNAs, Unmodified Duplexes (Asymmetrics)

```
                 5'-GAUUACCCGCCGAAUUCAUUAAUUU-3'    (SEQ ID NO: 2512)
                 3'-AACUAAUGGGCGGCUUAAGUAAUUAAA-5'  (SEQ ID NO: 2320)
MCL1-1562 Target: 5'-TTGATTACCCGCCGAATTCATTAATTT-3' (SEQ ID NO: 2416)

5'-CCGCCGAAUUCAUUAAUUUACUGUA-3'    (SEQ ID NO: 2513)
                 3'-UGGGCGGCUUAAGUAAUUAAAUGACAU-5' (SEQ ID NO: 2321)
MCL1-1568 Target: 5'-ACCCGCCGAATTCATTAATTTACTGTA-3' (SEQ ID NO: 2417)

5'-GAAUUCAUUAAUUUACUGUAGUGUU-3'    (SEQ ID NO: 2514)
                 3'-GGCUUAAGUAAUUAAAUGACAUCACAA-5' (SEQ ID NO: 2322)
MCL1-1573 Target: 5'-CCGAATTCATTAATTTACTGTAGTGTT-3' (SEQ ID NO: 2418)

5'-CCAAGUGUUCAGGACUUUUAUACCU-3'    (SEQ ID NO: 2515)
                 3'-CAGGUUCACAAGUCCUGAAAAUAUGGA-5' (SEQ ID NO: 2323)
MCL1-1732 Target: 5'-GTCCAAGTGTTCAGGACTTTTATACCT-3' (SEQ ID NO: 2419)

5'-AAGUGUUCAGGACUUUUAUACCUGU-3'    (SEQ ID NO: 2516)
                 3'-GGUUCACAAGUCCUGAAAAUAUGGACA-5' (SEQ ID NO: 2324)
MCL1-1734 Target: 5'-CCAAGTGTTCAGGACTTTTATACCTGT-3' (SEQ ID NO: 2420)

5'-UCAGGACUUUUAUACCUGUUAUACU-3'    (SEQ ID NO: 2517)
                 3'-CAAGUCCUGAAAAUAUGGACAAUAUGA-5' (SEQ ID NO: 2325)
MCL1-1740 Target: 5'-GTTCAGGACTTTTATACCTGTTATACT-3' (SEQ ID NO: 2421)

5'-AGGACUUUUAUACCUGUUAUACUUU-3'    (SEQ ID NO: 2518)
                 3'-AGUCCUGAAAAUAUGGACAAUAUGAAA-5' (SEQ ID NO: 2326)
MCL1-1742 Target: 5'-TCAGGACTTTTATACCTGTTATACTTT-3' (SEQ ID NO: 2422)

5'-CUUUUAUACCUGUUAUACUUUGGCU-3'    (SEQ ID NO: 2519)
                 3'-CUGAAAAUAUGGACAAUAUGAAACCGA-5' (SEQ ID NO: 2327)
MCL1-1746 Target: 5'-GACTTTTATACCTGTTATACTTTGGCT-3' (SEQ ID NO: 2423)

5'-CUAGUUUAUCACCAAUAAUACUUGA-3'    (SEQ ID NO: 2520)
                 3'-CGGAUCAAAUAGUGGUUAUUAUGAACU-5' (SEQ ID NO: 2328)
MCL1-1799 Target: 5'-GCCTAGTTTATCACCAATAATACTTGA-3' (SEQ ID NO: 2424)

5'-GACGGAAGGCUCAGUAAUUAGUUAU-3'    (SEQ ID NO: 2521)
                 3'-AACUGCCUUCCGAGUCAUUAAUCAAUA-5' (SEQ ID NO: 2329)
MCL1-1822 Target: 5'-TTGACGGAAGGCTCAGTAATTAGTTAT-3' (SEQ ID NO: 2425)

5'-CGGAAGGCUCAGUAAUUAGUUAUGA-3'    (SEQ ID NO: 2522)
                 3'-CUGCCUUCCGAGUCAUUAAUCAAUACU-5' (SEQ ID NO: 2330)
MCL1-1824 Target: 5'-GACGGAAGGCTCAGTAATTAGTTATGA-3' (SEQ ID NO: 2426)

5'-GAAGGCUCAGUAAUUAGUUAUGAAU-3'    (SEQ ID NO: 2523)
                 3'-GCCUUCCGAGUCAUUAAUCAAUACUUA-5' (SEQ ID NO: 2331)
MCL1-1826 Target: 5'-CGGAAGGCTCAGTAATTAGTTATGAAT-3' (SEQ ID NO: 2427)

5'-CUCAGUAAUUAGUUAUGAAUAUGGA-3'    (SEQ ID NO: 2524)
                 3'-CCGAGUCAUUAAUCAAUACUUAUACCU-5' (SEQ ID NO: 2332)
MCL1-1831 Target: 5'-GGCTCAGTAATTAGTTATGAATATGGA-3' (SEQ ID NO: 2428)

5'-CAGUAAUUAGUUAUGAAUAUGGAUA-3'    (SEQ ID NO: 2525)
                 3'-GAGUCAUUAAUCAAUACUUAUACCUAU-5' (SEQ ID NO: 2333)
MCL1-1833 Target: 5'-CTCAGTAATTAGTTATGAATATGGATA-3' (SEQ ID NO: 2429)

5'-GACAGCUUGUAAAUGUAUUUGUAAA-3'    (SEQ ID NO: 2526)
                 3'-UUCUGUCGAACAUUUACAUAAACAUUU-5' (SEQ ID NO: 2334)
MCL1-1872 Target: 5'-AAGACAGCTTGTAAATGTATTTGTAAA-3' (SEQ ID NO: 2430)

5'-AGCUUGUAAAUGUAUUUGUAAAAAU-3'    (SEQ ID NO: 2527)
                 3'-UGUCGAACAUUUACAUAAACAUUUUA-5'  (SEQ ID NO: 2335)
MCL1-1875 Target: 5'-ACAGCTTGTAAATGTATTTGTAAAAAT-3' (SEQ ID NO: 2431)

5'-GAAAGUCUAUUUCUUUGAAACGAAG-3'    (SEQ ID NO: 2528)
                 3'-GUCUUUCAGAUAAAGAAACUUUGCUUC-5' (SEQ ID NO: 2336)
MCL1-1916 Target: 5'-CAGAAAGTCTATTTCTTTGAAACGAAG-3' (SEQ ID NO: 2432)

5'-CGAAUUUACAUUAGUUUUUUUCAUA-3'    (SEQ ID NO: 2529)
                 3'-UAGCUUAAAUGUAAUCAAAAAAAGUAU-5' (SEQ ID NO: 2337)
MCL1-1948 Target: 5'-ATCGAATTTACATTAGTTTTTTTCATA-3' (SEQ ID NO: 2433)

5'-CAUUAGUUUUUUUCAUACCCUUUUG-3'    (SEQ ID NO: 2530)
                 3'-AUGUAAUCAAAAAAAGUAUGGGAAAAC-5' (SEQ ID NO: 2338)
MCL1-1956 Target: 5'-TACATTAGTTTTTTTCATACCCTTTTG-3' (SEQ ID NO: 2434)
```

TABLE 3-continued

Selected Human Anti-MCL1 DsiRNAs, Unmodified Duplexes (Asymmetrics)

|               |                                                     |                  |
|---------------|-----------------------------------------------------|------------------|
|               | 5'-UUAGUUUUUUCAUACCCUUUUGAA-3'                      | (SEQ ID NO: 2531)|
|               | 3'-GUAAUCAAAAAAGUAUGGGAAAACUU-5'                    | (SEQ ID NO: 2339)|
| MCL1-1958 Target: | 5'-CATTAGTTTTTTTCATACCCTTTTGAA-3'               | (SEQ ID NO: 2435)|
|               | 5'-CAUACCCUUUUGAACUUUGCAACUU-3'                     | (SEQ ID NO: 2532)|
|               | 3'-AAGUAUGGGAAAACUUGAAACGUUGAA-5'                   | (SEQ ID NO: 2340)|
| MCL1-1969 Target: | 5'-TTCATACCCTTTTGAACTTTGCAACTT-3'               | (SEQ ID NO: 2436)|
|               | 5'-CUUUUCUAUGCUAAACUUUGUUCUG-3'                     | (SEQ ID NO: 2533)|
|               | 3'-UCGAAAAGAUACGAUUUGAAACAAGAC-5'                   | (SEQ ID NO: 2341)|
| MCL1-2021 Target: | 5'-AGCTTTTCTATGCTAAACTTTGTTCTG-3'               | (SEQ ID NO: 2437)|
|               | 5'-CUAAACUUUGUUCUGUUCAGUUCUA-3'                     | (SEQ ID NO: 2534)|
|               | 3'-ACGAUUUGAAACAAGACAAGUCAAGAU-5'                   | (SEQ ID NO: 2342)|
| MCL1-2031 Target: | 5'-TGCTAAACTTTGTTCTGTTCAGTTCTA-3'               | (SEQ ID NO: 2438)|
|               | 5'-AAACUUUGUUCUGUUCAGUUCUAGA-3'                     | (SEQ ID NO: 2535)|
|               | 3'-GAUUUGAAACAAGACAAGUCAAGAUCU-5'                   | (SEQ ID NO: 2343)|
| MCL1-2033 Target: | 5'-CTAAACTTTGTTCTGTTCAGTTCTAGA-3'               | (SEQ ID NO: 2439)|
|               | 5'-GUAUGCAGACUGGUUGUAGUGGAAC-3'                     | (SEQ ID NO: 2536)|
|               | 3'-GACAUACGUCUGACCAACAUCACCUUG-5'                   | (SEQ ID NO: 2344)|
| MCL1-2087 Target: | 5'-CTGTATGCAGACTGGTTGTAGTGGAAC-3'               | (SEQ ID NO: 2440)|
|               | 5'-GCAGACUGGUUGUAGUGGAACAAAU-3'                     | (SEQ ID NO: 2537)|
|               | 3'-UACGUCUGACCAACAUCACCUUGUUUA-5'                   | (SEQ ID NO: 2345)|
| MCL1-2091 Target: | 5'-ATGCAGACTGGTTGTAGTGGAACAAAT-3'               | (SEQ ID NO: 2441)|
|               | 5'-GGAACAAAUCUGAUAACUAUGCAGG-3'                     | (SEQ ID NO: 2538)|
|               | 3'-CACCUUGUUUAGACUAUUGAUACGUCC-5'                   | (SEQ ID NO: 2346)|
| MCL1-2107 Target: | 5'-GTGGAACAAATCTGATAACTATGCAGG-3'               | (SEQ ID NO: 2442)|
|               | 5'-GAGAGGUUGAUGAAUGGAAAUUCUU-3'                     | (SEQ ID NO: 2539)|
|               | 3'-AACUCUCCAACUACUUACCUUUAAGAA-5'                   | (SEQ ID NO: 2347)|
| MCL1-2199 Target: | 5'-TTGAGAGGTTGATGAATGGAAATTCTT-3'               | (SEQ ID NO: 2443)|
|               | 5'-AUGGAAAUUCUUUCACUUCAUUAUA-3'                     | (SEQ ID NO: 2540)|
|               | 3'-CUUACCUUUAAGAAAGUGAAGUAAUAU-5'                   | (SEQ ID NO: 2348)|
| MCL1-2212 Target: | 5'-GAATGGAAATTCTTTCACTTCATTATA-3'               | (SEQ ID NO: 2444)|
|               | 5'-GAAAUUCUUUCACUUCAUUAUAUGC-3'                     | (SEQ ID NO: 2541)|
|               | 3'-ACCUUUAAGAAAGUGAAGUAAUAUACG-5'                   | (SEQ ID NO: 2349)|
| MCL1-2215 Target: | 5'-TGGAAATTCTTTCACTTCATTATATGC-3'               | (SEQ ID NO: 2445)|
|               | 5'-AAUUCUUUCACUUCAUUAUAUGCAA-3'                     | (SEQ ID NO: 2542)|
|               | 3'-CUUUAAGAAAGUGAAGUAAUAUACGUU-5'                   | (SEQ ID NO: 2350)|
| MCL1-2217 Target: | 5'-GAAATTCTTTCACTTCATTATATGCAA-3'               | (SEQ ID NO: 2446)|
|               | 5'-CACUUCAUUAUAUGCAAGUUUUCAA-3'                     | (SEQ ID NO: 2543)|
|               | 3'-AAGUGAAGUAAUAUACGUUCAAAAGUU-5'                   | (SEQ ID NO: 2351)|
| MCL1-2225 Target: | 5'-TTCACTTCATTATATGCAAGTTTTCAA-3'               | (SEQ ID NO: 2447)|
|               | 5'-CUUCAUUAUAUGCAAGUUUUCAAUA-3'                     | (SEQ ID NO: 2544)|
|               | 3'-GUGAAGUAAUAUACGUUCAAAAGUUAU-5'                   | (SEQ ID NO: 2352)|
| MCL1-2227 Target: | 5'-CACTTCATTATATGCAAGTTTTCAATA-3'               | (SEQ ID NO: 2448)|
|               | 5'-CAUUAUAUGCAAGUUUUCAAUAAUU-3'                     | (SEQ ID NO: 2545)|
|               | 3'-AAGUAAUAUACGUUCAAAAGUUAUUAA-5'                   | (SEQ ID NO: 2353)|
| MCL1-2230 Target: | 5'-TTCATTATATGCAAGTTTTCAATAATT-3'               | (SEQ ID NO: 2449)|
|               | 5'-UUAUAUGCAAGUUUUCAAUAAUUAG-3'                     | (SEQ ID NO: 2546)|
|               | 3'-GUAAUAUACGUUCAAAAGUUAUUAAUC-5'                   | (SEQ ID NO: 2354)|
| MCL1-2232 Target: | 5'-CATTATATGCAAGTTTTCAATAATTAG-3'               | (SEQ ID NO: 2450)|
|               | 5'-AUGCAAGUUUUCAAUAAUUAGGUCU-3'                     | (SEQ ID NO: 2547)|
|               | 3'-UAUACGUUCAAAAGUUAUUAAUCCAGA-5'                   | (SEQ ID NO: 2355)|
| MCL1-2236 Target: | 5'-ATATGCAAGTTTTCAATAATTAGGTCT-3'               | (SEQ ID NO: 2451)|
|               | 5'-GGUUACUGAUGACUUACAAAUAAUG-3'                     | (SEQ ID NO: 2548)|
|               | 3'-UUCCAAUGACUACUGAAUGUUUAUUAC-5'                   | (SEQ ID NO: 2356)|
| MCL1-2275 Target: | 5'-AAGGTTACTGATGACTTACAAATAATG-3'               | (SEQ ID NO: 2452)|
|               | 5'-CUGAUUGGGCAAUACUCAUUUGAGU-3'                     | (SEQ ID NO: 2549)|
|               | 3'-GAGACUAACCCGUUAUGAGUAAACUCA-5'                   | (SEQ ID NO: 2357)|
| MCL1-2304 Target: | 5'-CTCTGATTGGGCAATACTCATTTGAGT-3'               | (SEQ ID NO: 2453)|

TABLE 3-continued

Selected Human Anti-MCL1 DsiRNAs, Unmodified Duplexes (Asymmetrics)

```
                   5'-AAUACUCAUUUGAGUUCCUUCCAUU-3'      (SEQ ID NO: 2550)
                   3'-CGUUAUGAGUAAACUCAAGGAAGGUAA-5'    (SEQ ID NO: 2358)
MCL1-2314 Target:  5'-GCAATACTCATTTGAGTTCCTTCCATT-3'    (SEQ ID NO: 2454)

5'-CUGGUGAAAUUUAAAGUGAAUUCAU-3'      (SEQ ID NO: 2551)
                   3'-UUGACCACUUUAAAUUUCACUUAAGUA-5'    (SEQ ID NO: 2359)
MCL1-2352 Target:  5'-AACTGGTGAAATTTAAAGTGAATTCAT-3'    (SEQ ID NO: 2455)

5'-CAUUUGAUCCCUUGUUUGCUUAAUA-3'      (SEQ ID NO: 2552)
                   3'-CUGUAAACUAGGGAACAAACGAAUUAU-5'    (SEQ ID NO: 2360)
MCL1-2473 Target:  5'-GACATTTGATCCCTTGTTTGCTTAATA-3'    (SEQ ID NO: 2456)

5'-GAUCCCUUGUUUGCUUAAUAAAUUA-3'      (SEQ ID NO: 2553)
                   3'-AACUAGGGAACAAACGAAUUAUUUAAU-5'    (SEQ ID NO: 2361)
MCL1-2478 Target:  5'-TTGATCCCTTGTTTGCTTAATAAATTA-3'    (SEQ ID NO: 2457)

5'-CUUGUUUGCUUAAUAAAUUAUAAAA-3'      (SEQ ID NO: 2554)
                   3'-GGGAACAAACGAAUUAUUUAAUAUUUU-5'    (SEQ ID NO: 2362)
MCL1-2483 Target:  5'-CCCTTGTTTGCTTAATAAATTATAAAA-3'    (SEQ ID NO: 2458)

5'-GUUUGCUUAAUAAAUUAUAAAAUGA-3'      (SEQ ID NO: 2555)
                   3'-AACAAACGAAUUAUUUAAUAUUUUACU-5'    (SEQ ID NO: 2363)
MCL1-2486 Target:  5'-TTGTTTGCTTAATAAATTATAAAATGA-3'    (SEQ ID NO: 2459)

5'-UAUAAAAUGAUGGCUUGGAAAAGCA-3'      (SEQ ID NO: 2556)
                   3'-UAAUAUUUUACUACCGAACCUUUUCGU-5'    (SEQ ID NO: 2364)
MCL1-2501 Target:  5'-ATTATAAAATGATGGCTTGGAAAAGCA-3'    (SEQ ID NO: 2460)

5'-GGUCUAAGCCUAGUAUGUCAAUAAA-3'      (SEQ ID NO: 2557)
                   3'-GUCCAGAUUCGGAUCAUACAGUUAUUU-5'    (SEQ ID NO: 2365)
MCL1-2575 Target:  5'-CAGGTCTAAGCCTAGTATGTCAATAAA-3'    (SEQ ID NO: 2461)

5'-CUAGUAUGUCAAUAAAGCAAAUACU-3'      (SEQ ID NO: 2558)
                   3'-CGGAUCAUACAGUUAUUUCGUUUAUGA-5'    (SEQ ID NO: 2366)
MCL1-2584 Target:  5'-GCCTAGTATGTCAATAAAGCAAATACT-3'    (SEQ ID NO: 2462)

5'-GUCAAUAAAGCAAAUACUUACUGUU-3'      (SEQ ID NO: 2559)
                   3'-UACAGUUAUUUCGUUUAUGAAUGACAA-5'    (SEQ ID NO: 2367)
MCL1-2591 Target:  5'-ATGTCAATAAAGCAAATACTTACTGTT-3'    (SEQ ID NO: 2463)

5'-CAAUAAAGCAAAUACUUACUGUUUU-3'      (SEQ ID NO: 2560)
                   3'-CAGUUAUUUCGUUUAUGAAUGACAAAA-5'    (SEQ ID NO: 2368)
MCL1-2593 Target:  5'-GTCAATAAAGCAAATACTTACTGTTTT-3'    (SEQ ID NO: 2464)

5'-UAAAGCAAAUACUUACUGUUUUGUU-3'      (SEQ ID NO: 2561)
                   3'-UUAUUUCGUUUAUGAAUGACAAAACAA-5'    (SEQ ID NO: 2369)
MCL1-2596 Target:  5'-AATAAAGCAAATACTTACTGTTTTGTT-3'    (SEQ ID NO: 2465)

5'-AAGCAAAUACUUACUGUUUUGUUUC-3'      (SEQ ID NO: 2562)
                   3'-AUUUCGUUUAUGAAUGACAAAACAAAG-5'    (SEQ ID NO: 2370)
MCL1-2598 Target:  5'-TAAAGCAAATACTTACTGTTTTGTTTC-3'    (SEQ ID NO: 2466)

5'-AAAUACUUACUGUUUUGUUUCUAUU-3'      (SEQ ID NO: 2563)
                   3'-CGUUUAUGAAUGACAAAACAAAGAUAA-5'    (SEQ ID NO: 2371)
MCL1-2602 Target:  5'-GCAAATACTTACTGTTTTGTTTCTATT-3'    (SEQ ID NO: 2467)

5'-UACUUACUGUUUUGUUUCUAUUAAU-3'      (SEQ ID NO: 2564)
                   3'-UUAUGAAUGACAAAACAAAGAUAAUUA-5'    (SEQ ID NO: 2372)
MCL1-2605 Target:  5'-AATACTTACTGTTTTGTTTCTATTAAT-3'    (SEQ ID NO: 2468)

5'-CUUACUGUUUUGUUUCUAUUAAUGA-3'      (SEQ ID NO: 2565)
                   3'-AUGAAUGACAAAACAAAGAUAAUUACU-5'    (SEQ ID NO: 2373)
MCL1-2607 Target:  5'-TACTTACTGTTTTGTTTCTATTAATGA-3'    (SEQ ID NO: 2469)

5'-UACUGUUUUGUUUCUAUUAAUGAUU-3'      (SEQ ID NO: 2566)
                   3'-GAAUGACAAAACAAAGAUAAUUACUAA-5'    (SEQ ID NO: 2374)
MCL1-2609 Target:  5'-CTTACTGTTTTGTTTCTATTAATGATT-3'    (SEQ ID NO: 2470)

5'-GUUUUGUUUCUAUUAAUGAUUCCCA-3'      (SEQ ID NO: 2567)
                   3'-GACAAAACAAAGAUAAUUACUAAGGGU-5'    (SEQ ID NO: 2375)
MCL1-2613 Target:  5'-CTGTTTTGTTTCTATTAATGATTCCCA-3'    (SEQ ID NO: 2471)

5'-UUAAUGAUUCCCAAACCUUGUUGCA-3'      (SEQ ID NO: 2568)
                   3'-AUAAUUACUAAGGGUUUGGAACAACGU-5'    (SEQ ID NO: 2376)
MCL1-2625 Target:  5'-TATTAATGATTCCCAAACCTTGTTGCA-3'    (SEQ ID NO: 2472)
```

TABLE 3-continued

Selected Human Anti-MCL1 DsiRNAs, Unmodified Duplexes (Asymmetrics)

|  |  |  |
|---|---|---|
| MCL1-2636 Target: | 5'-CAAACCUUGUUGCAAGUUUUUGCAU-3'<br>3'-GGGUUUGGAACAACGUUCAAAAACGUA-5'<br>5'-CCCAAACCTTGTTGCAAGTTTTTGCAT-3' | (SEQ ID NO: 2569)<br>(SEQ ID NO: 2377)<br>(SEQ ID NO: 2473) |
| MCL1-2672 Target: | 5'-GAUUUCAGUCUUGAUGUUUGUUCUA-3'<br>3'-ACCUAAAGUCAGAACUACAAACAAGAU-5'<br>5'-TGGATTTCAGTCTTGATGTTTGTTCTA-3' | (SEQ ID NO: 2570)<br>(SEQ ID NO: 2378)<br>(SEQ ID NO: 2474) |
| MCL1-2679 Target: | 5'-GUCUUGAUGUUUGUUCUAUCAGACU-3'<br>3'-GUCAGAACUACAAACAAGAUAGUCUGA-5'<br>5'-CAGTCTTGATGTTTGTTCTATCAGACT-3' | (SEQ ID NO: 2571)<br>(SEQ ID NO: 2379)<br>(SEQ ID NO: 2475) |
| MCL1-2790 Target: | 5'-CUGCCAUCCCUGAACUCUUUCUAGC-3'<br>3'-GGGACGGUAGGGACUUGAGAAAGAUCG-5'<br>5'-CCCTGCCATCCCTGAACTCTTTCTAGC-3' | (SEQ ID NO: 2572)<br>(SEQ ID NO: 2380)<br>(SEQ ID NO: 2476) |
| MCL1-2799 Target: | 5'-CUGAACUCUUUCUAGCCCUUUUAGA-3'<br>3'-GGGACUUGAGAAAGAUCGGGAAAAUCU-5'<br>5'-CCCTGAACTCTTTCTAGCCCTTTTAGA-3' | (SEQ ID NO: 2573)<br>(SEQ ID NO: 2381)<br>(SEQ ID NO: 2477) |
| MCL1-2801 Target: | 5'-GAACUCUUUCUAGCCCUUUUAGAUU-3'<br>3'-GACUUGAGAAAGAUCGGGAAAAUCUAA-5'<br>5'-CTGAACTCTTTCTAGCCCTTTTAGATT-3' | (SEQ ID NO: 2574)<br>(SEQ ID NO: 2382)<br>(SEQ ID NO: 2478) |
| MCL1-2911 Target: | 5'-GAUCCUGUUAGCAGGUGGUAAUACC-3'<br>3'-AACUAGGACAAUCGUCCACCAUUAUGG-5'<br>5'-TTGATCCTGTTAGCAGGTGGTAATACC-3' | (SEQ ID NO: 2575)<br>(SEQ ID NO: 2383)<br>(SEQ ID NO: 2479) |
| MCL1-2992 Target: | 5'-GACUGGUAUCUUUUCAACUAUUGUU-3'<br>3'-ACCUGACCAUAGAAAAGUUGAUAACAA-5'<br>5'-TGGACTGGTATCTTTTCAACTATTGTT-3' | (SEQ ID NO: 2576)<br>(SEQ ID NO: 2384)<br>(SEQ ID NO: 2480) |
| MCL1-3072 Target: | 5'-AAGAACAUUUUAUGAGGCUUUCUCU-3'<br>3'-CUUUCUUGUAAAAUACUCCGAAAGAGA-5'<br>5'-GAAAGAACATTTTATGAGGCTTTCTCT-3' | (SEQ ID NO: 2577)<br>(SEQ ID NO: 2385)<br>(SEQ ID NO: 2481) |
| MCL1-3074 Target: | 5'-GAACAUUUUAUGAGGCUUUCUCUAA-3'<br>3'-UUCUUGUAAAAUACUCCGAAAGAGAUU-5'<br>5'-AAGAACATTTTATGAGGCTTTCTCTAA-3' | (SEQ ID NO: 2578)<br>(SEQ ID NO: 2386)<br>(SEQ ID NO: 2482) |
| MCL1-3252 Target: | 5'-AGUCUGUGGACUCCAUUUAAAAAUA-3'<br>3'-AAUCAGACACCUGAGGUAAAUUUUUAU-5'<br>5'-TTAGTCTGTGGACTCCATTTAAAAATA-3' | (SEQ ID NO: 2579)<br>(SEQ ID NO: 2387)<br>(SEQ ID NO: 2483) |
| MCL1-3563 Target: | 5'-CAUUAGGUAUGACUGUGGAAAUACA-3'<br>3'-AAGUAAUCCAUACUGACACCUUUAUGU-5'<br>5'-TTCATTAGGTATGACTGTGGAAATACA-3' | (SEQ ID NO: 2580)<br>(SEQ ID NO: 2388)<br>(SEQ ID NO: 2484) |
| MCL1-3588 Target: | 5'-GACAAGGAUCUUAGUUGAUAUUUUG-3'<br>3'-GUCUGUUCCUAGAAUCAACUAUAAAAC-5'<br>5'-CAGACAAGGATCTTAGTTGATATTTTG-3' | (SEQ ID NO: 2581)<br>(SEQ ID NO: 2389)<br>(SEQ ID NO: 2485) |
| MCL1-3789 Target: | 5'-GACUACUUUUUGACUUCUGUUUGUC-3'<br>3'-CACUGAUGAAAAACUGAAGACAAACAG-5'<br>5'-GTGACTACTTTTTGACTTCTGTTTGTC-3' | (SEQ ID NO: 2582)<br>(SEQ ID NO: 2390)<br>(SEQ ID NO: 2486) |
| MCL1-3989 Target: | 5'-CUGUUUUUCCUGAGAAAAAAAAUA-3'<br>3'-AAGACAAAAAGGACUCUUUUUUUUAU-5'<br>5'-TTCTGTTTTTCCTGAGAAAAAAAATA-3' | (SEQ ID NO: 2583)<br>(SEQ ID NO: 2391)<br>(SEQ ID NO: 2487) |
| MCL1-3991 Target: | 5'-GUUUUUCCUGAGAAAAAAAAUAAA-3'<br>3'-GACAAAAAGGACUCUUUUUUUUAUUU-5'<br>5'-CTGTTTTTCCTGAGAAAAAAAATAAA-3' | (SEQ ID NO: 2584)<br>(SEQ ID NO: 2392)<br>(SEQ ID NO: 2488) |
| MCL1-3997 Target: | 5'-CCUGAGAAAAAAAAUAAAUCUUUU-3'<br>3'-AAGGACUCUUUUUUUUAUUUAGAAAA-5'<br>5'-TTCCTGAGAAAAAAAATAAATCTTTT-3' | (SEQ ID NO: 2585)<br>(SEQ ID NO: 2393)<br>(SEQ ID NO: 2489) |
| MCL1-4000 Target: | 5'-GAGAAAAAAAAUAAAUCUUUUAUU-3'<br>3'-GACUCUUUUUUUUAUUUAGAAAAUAA-5'<br>5'-CTGAGAAAAAAAATAAATCTTTTATT-3' | (SEQ ID NO: 2586)<br>(SEQ ID NO: 2394)<br>(SEQ ID NO: 2490) |
| MCL1-4002 Target: | 5'-GAAAAAAAAUAAAUCUUUUAUUCA-3'<br>3'-CUCUUUUUUUUAUUUAGAAAAUAAGU-5'<br>5'-GAGAAAAAAAATAAATCTTTTATTCA-3' | (SEQ ID NO: 2587)<br>(SEQ ID NO: 2395)<br>(SEQ ID NO: 2491) |

TABLE 3-continued

Selected Human Anti-MCL1 DsiRNAs, Unmodified Duplexes (Asymmetrics)

```
                5'-AAAAUAAAUCUUUUAUUCAAAAAAA-3'    (SEQ ID NO: 2588)
                3'-UUUUUUAUUUAGAAAAUAAGUUUUUUU-5'  (SEQ ID NO: 2396)
MCL1-4008 Target: 5'-AAAAAATAAATCTTTTATTCAAAAAAA-3' (SEQ ID NO: 2492)
```

TABLE 4

Selected Mouse Anti-MCL1 DsiRNAs (Asymmetrics)

```
                 5'-GGAACGGCCUUCCUCACUCCUGAct-3'   (SEQ ID NO: 201)
                 3'-UCCCUUGCCGGAAGGAGUGAGGACUGA-5' (SEQ ID NO: 516)
MCL1-m69 Target:  5'-AGGGAACGGCCTTCCTCACTCCTGACT-3' (SEQ ID NO: 831)

5'-GCGGAGAAACGCGGUCAUCGGCUtg-3'   (SEQ ID NO: 202)
                 3'-GACGCCUCUUUGCGCCAGUAGCCGAAC-5' (SEQ ID NO: 517)
MCL1-m172 Target: 5'-CTGCGGAGAAACGCGGTCATCGGCTTG-3' (SEQ ID NO: 832)

5'-GGAGGAGGAACUGGACGGCUGCGag-3'   (SEQ ID NO: 203)
                 3'-GGCCUCCUCCUUGACCUGCCGACGCUC-5' (SEQ ID NO: 518)
MCL1-m469 Target: 5'-CCGGAGGAGGAACTGGACGGCTGCGAG-3' (SEQ ID NO: 833)

5'-AGGAGGAAGAGGACGACCUAUACCg-3'   (SEQ ID NO: 204)
                 3'-GCUCCUCCUUCUCCUGCUGGAUAUGGC-5' (SEQ ID NO: 519)
MCL1-m606 Target: 5'-CGAGGAGGAAGAGGACGACCTATACCG-3' (SEQ ID NO: 834)

5'-GGAGGAAGAGGACGACCUAUACCgc-3'   (SEQ ID NO: 205)
                 3'-CUCCUCCUUCUCCUGCUGGAUAUGGCG-5' (SEQ ID NO: 520)
MCL1-m607 Target: 5'-GAGGAGGAAGAGGACGACCTATACCGC-3' (SEQ ID NO: 835)

5'-GAGGAAGAGGACGACCUAUACCGcc-3'   (SEQ ID NO: 206)
                 3'-UCCUCCUUCUCCUGCUGGAUAUGGCGG-5' (SEQ ID NO: 521)
MCL1-m608 Target: 5'-AGGAGGAAGAGGACGACCTATACCGCC-3' (SEQ ID NO: 836)

5'-GGAAGAGGACGACCUAUACCGCCag-3'   (SEQ ID NO: 207)
                 3'-CUCCUUCUCCUGCUGGAUAUGGCGGUC-5' (SEQ ID NO: 522)
MCL1-m610 Target: 5'-GAGGAAGAGGACGACCTATACCGCCAG-3' (SEQ ID NO: 837)

5'-GGAUUGUGACUCUUAUUUCUUUCgg-3'   (SEQ ID NO: 208)
                 3'-GUCCUAACACUGAGAAUAAAGAAAGCC-5' (SEQ ID NO: 523)
MCL1-m891 Target: 5'-CAGGATTGTGACTCTTATTTCTTTCGG-3' (SEQ ID NO: 838)

5'-UGGCCAAACACUUAAAGAGCGUAaa-3'   (SEQ ID NO: 209)
                 3'-ACACCGGUUUGUGAAUUUCUCGCAUUU-5' (SEQ ID NO: 524)
MCL1-m924 Target: 5'-TGTGGCCAAACACTTAAAGAGCGTAAA-3' (SEQ ID NO: 839)

5'-GGCCAAACACUUAAAGAGCGUAAac-3'   (SEQ ID NO: 210)
                 3'-CACCGGUUUGUGAAUUUCUCGCAUUUG-5' (SEQ ID NO: 525)
MCL1-m925 Target: 5'-GTGGCCAAACACTTAAAGAGCGTAAAC-3' (SEQ ID NO: 840)

5'-GCCAAACACUUAAAGAGCGUAAAcc-3'   (SEQ ID NO: 211)
                 3'-ACCGGUUUGUGAAUUUCUCGCAUUUGG-5' (SEQ ID NO: 526)
MCL1-m926 Target: 5'-TGGCCAAACACTTAAAGAGCGTAAACC-3' (SEQ ID NO: 841)

5'-AGAGCGUAAACCAAGAAAGCUUCat-3'   (SEQ ID NO: 212)
                 3'-UUUCUCGCAUUUGGUUCUUUCGAAGUA-5' (SEQ ID NO: 527)
MCL1-m939 Target: 5'-AAAGAGCGTAAACCAAGAAAGCTTCAT-3' (SEQ ID NO: 842)

5'-AACCAUUAGCAGAAACUAUCACAga-3'   (SEQ ID NO: 213)
                 3'-GCUUGGUAAUCGUCUUUGAUAGUGUCU-5' (SEQ ID NO: 528)
MCL1-m966 Target: 5'-CGAACCATTAGCAGAAACTATCACAGA-3' (SEQ ID NO: 843)

5'-AGCAGAAACUAUCACAGAUGUUCtt-3'   (SEQ ID NO: 214)
                 3'-AAUCGUCUUUGAUAGUGUCUACAAGAA-5' (SEQ ID NO: 529)
MCL1-m973 Target: 5'-TTAGCAGAAACTATCACAGATGTTCTT-3' (SEQ ID NO: 844)

5'-GGGACUGGCUUGUCAAACAAAGAgg-3'   (SEQ ID NO: 215)
                 3'-UGCCCUGACCGAACAGUUUGUUUCUCC-5' (SEQ ID NO: 530)
MCL1-m1011 Target: 5'-ACGGGACTGGCTTGTCAAACAAAGAGG-3' (SEQ ID NO: 845)

5'-GGACUGGCUUGUCAAACAAAGAGgc-3'   (SEQ ID NO: 216)
                 3'-GCCCUGACCGAACAGUUUGUUUCUCCG-5' (SEQ ID NO: 531)
MCL1-m1012 Target: 5'-CGGGACTGGCTTGTCAAACAAAGAGGC-3' (SEQ ID NO: 846)

5'-GUGGAGUUCUUCCACGUACAGGAcc-3'   (SEQ ID NO: 217)
                 3'-AACACCUCAAGAAGGUGCAUGUCCUGG-5' (SEQ ID NO: 532)
MCL1-m1049 Target: 5'-TTGTGGAGTTCTTCCACGTACAGGACC-3' (SEQ ID NO: 847)
```

TABLE 4-continued

Selected Mouse Anti-MCL1 DsiRNAs (Asymmetrics)

|  |  |  |
|---|---|---|
|  | 5'-AGUUCUUCCACGUACAGGACCUAga-3' | (SEQ ID NO: 218) |
|  | 3'-CCUCAAGAAGGUGCAUGUCCUGGAUCU-5' | (SEQ ID NO: 533) |
| MCL1-m1053 Target: | 5'-GGAGTTCTTCCACGTACAGGACCTAGA-3' | (SEQ ID NO: 848) |
|  | 5'-CCACGUACAGGACCUAGAAGGCGgc-3' | (SEQ ID NO: 219) |
|  | 3'-AAGGUGCAUGUCCUGGAUCUUCCGCCG-5' | (SEQ ID NO: 534) |
| MCL1-m1060 Target: | 5'-TTCCACGTACAGGACCTAGAAGGCGGC-3' | (SEQ ID NO: 849) |
|  | 5'-GGUCUGGCAUAUCUAAUAAGAUAgc-3' | (SEQ ID NO: 220) |
|  | 3'-GACCAGACCGUAUAGAUUAUUCUAUCG-5' | (SEQ ID NO: 535) |
| MCL1-m1133 Target: | 5'-CTGGTCTGGCATATCTAATAAGATAGC-3' | (SEQ ID NO: 850) |
|  | 5'-CCACCAAACUACAUGCAUCUGUGaa-3' | (SEQ ID NO: 221) |
|  | 3'-UCGGUGGUUUGAUGUACGUAGACACUU-5' | (SEQ ID NO: 536) |
| MCL1-m1193 Target: | 5'-AGCCACCAAACTACATGCATCTGTGAA-3' | (SEQ ID NO: 851) |
|  | 5'-UGUGUAUUUAUGAAGGUGGACUUga-3' | (SEQ ID NO: 222) |
|  | 3'-GUACACAUAAAUACUUCCACCUGAACU-5' | (SEQ ID NO: 537) |
| MCL1-m1222 Target: | 5'-CATGTGTATTTATGAAGGTGGACTTGA-3' | (SEQ ID NO: 852) |
|  | 5'-UGUAUUUAUGAAGGUGGACUUGAag-3' | (SEQ ID NO: 223) |
|  | 3'-ACACAUAAAUACUUCCACCUGAACUUC-5' | (SEQ ID NO: 538) |
| MCL1-m1224 Target: | 5'-TGTGTATTTATGAAGGTGGACTTGAAG-3' | (SEQ ID NO: 853) |
|  | 5'-AUUUAUGAAGGUGGACUUGAAGCtg-3' | (SEQ ID NO: 224) |
|  | 3'-CAUAAAUACUUCCACCUGAACUUCGAC-5' | (SEQ ID NO: 539) |
| MCL1-m1227 Target: | 5'-GTATTTATGAAGGTGGACTTGAAGCTG-3' | (SEQ ID NO: 854) |
|  | 5'-CCAGUUCUACUGUAGCAACAUAGca-3' | (SEQ ID NO: 225) |
|  | 3'-CAGGUCAAGAUGACAUCGUUGUAUCGU-5' | (SEQ ID NO: 540) |
| MCL1-m1269 Target: | 5'-GTCCAGTTCTACTGTAGCAACATAGCA-3' | (SEQ ID NO: 855) |
|  | 5'-CUGGAAGAGUCACUGUCUGAAUGaa-3' | (SEQ ID NO: 226) |
|  | 3'-GGGACCUUCUCAGUGACAGACUUACUU-5' | (SEQ ID NO: 541) |
| MCL1-m1355 Target: | 5'-CCCTGGAAGAGTCACTGTCTGAATGAA-3' | (SEQ ID NO: 856) |
|  | 5'-UGGAAGAGUCACUGUCUGAAUGAag-3' | (SEQ ID NO: 227) |
|  | 3'-GGACCUUCUCAGUGACAGACUUACUUC-5' | (SEQ ID NO: 542) |
| MCL1-m1356 Target: | 5'-CCTGGAAGAGTCACTGTCTGAATGAAG-3' | (SEQ ID NO: 857) |
|  | 5'-GGAAGAGUCACUGUCUGAAUGAAgc-3' | (SEQ ID NO: 228) |
|  | 3'-GACCUUCUCAGUGACAGACUUACUUCG-5' | (SEQ ID NO: 543) |
| MCL1-m1357 Target: | 5'-CTGGAAGAGTCACTGTCTGAATGAAGC-3' | (SEQ ID NO: 858) |
|  | 5'-CUGUCUGAAUGAAGCAAAGUUCCct-3' | (SEQ ID NO: 229) |
|  | 3'-GUGACAGACUUACUUCGUUUCAAGGGA-5' | (SEQ ID NO: 544) |
| MCL1-m1367 Target: | 5'-CACTGTCTGAATGAAGCAAAGTTCCCT-3' | (SEQ ID NO: 859) |
|  | 5'-CCCUCUCAGCAAACACUGAGAGGcc-3' | (SEQ ID NO: 230) |
|  | 3'-AAGGGAGAGUCGUUUGUGACUCUCCGG-5' | (SEQ ID NO: 545) |
| MCL1-m1388 Target: | 5'-TTCCCTCTCAGCAAACACTGAGAGGCC-3' | (SEQ ID NO: 860) |
|  | 5'-CCUCUCAGCAAACACUGAGAGGCca-3' | (SEQ ID NO: 231) |
|  | 3'-AGGGAGAGUCGUUUGUGACUCUCCGGU-5' | (SEQ ID NO: 546) |
| MCL1-m1389 Target: | 5'-TCCCTCTCAGCAAACACTGAGAGGCCA-3' | (SEQ ID NO: 861) |
|  | 5'-AGCAAACACUGAGAGGCCAUGGAga-3' | (SEQ ID NO: 232) |
|  | 3'-AGUCGUUUGUGACUCUCCGGUACCUCU-5' | (SEQ ID NO: 547) |
| MCL1-m1395 Target: | 5'-TCAGCAAACACTGAGAGGCCATGGAGA-3' | (SEQ ID NO: 862) |
|  | 5'-CACUGAGAGGCCAUGGAGAAGGAct-3' | (SEQ ID NO: 233) |
|  | 3'-UUGUGACUCUCCGGUACCUCUUCCUGA-5' | (SEQ ID NO: 548) |
| MCL1-m1401 Target: | 5'-AACACTGAGAGGCCATGGAGAAGGACT-3' | (SEQ ID NO: 863) |
|  | 5'-GGCCAUGGAGAAGGACUUCUAGAat-3' | (SEQ ID NO: 234) |
|  | 3'-CUCCGGUACCUCUUCCUGAAGAUCUUA-5' | (SEQ ID NO: 549) |
| MCL1-m1409 Target: | 5'-GAGGCCATGGAGAAGGACTTCTAGAAT-3' | (SEQ ID NO: 864) |
|  | 5'-GCCAUGGAGAAGGACUUCUAGAAtg-3' | (SEQ ID NO: 235) |
|  | 3'-UCCGGUACCUCUUCCUGAAGAUCUUAC-5' | (SEQ ID NO: 550) |
| MCL1-m1410 Target: | 5'-AGGCCATGGAGAAGGACTTCTAGAATG-3' | (SEQ ID NO: 865) |
|  | 5'-GAGAAGGACUUCUAGAAUGAAUGaa-3' | (SEQ ID NO: 236) |
|  | 3'-ACCUCUUCCUGAAGAUCUUACUUACUU-5' | (SEQ ID NO: 551) |
| MCL1-m1416 Target: | 5'-TGGAGAAGGACTTCTAGAATGAATGAA-3' | (SEQ ID NO: 866) |

TABLE 4-continued

Selected Mouse Anti-MCL1 DsiRNAs (Asymmetrics)

| | | |
|---|---|---|
| | 5'-AGGACUUCUAGAAUGAAUGAAAGgg-3' | (SEQ ID NO: 237) |
| | 3'-CUUCCUGAAGAUCUUACUUACUUUCCC-5' | (SEQ ID NO: 552) |
| MCL1-m1420 Target: | 5'-GAAGGACTTCTAGAATGAATGAAAGGG-3' | (SEQ ID NO: 867) |
| | 5'-GGAUGGAAAGGUUUGAUUUCCUAtc-3' | (SEQ ID NO: 238) |
| | 3'-CACCCUACCUUUCCAAACUAAAGGAUAG-5' | (SEQ ID NO: 553) |
| MCL1-m1447 Target: | 5'-GTGGATGGAAAGGTTTGATTTCCTATC-3' | (SEQ ID NO: 868) |
| | 5'-AGUCAUCAGGCUAGUCACAAAGCtc-3' | (SEQ ID NO: 239) |
| | 3'-GGUCAGUAGUCCGAUCAGUGUUUCGAG-5' | (SEQ ID NO: 554) |
| MCL1-m1491 Target: | 5'-CCAGTCATCAGGCTAGTCACAAAGCTC-3' | (SEQ ID NO: 869) |
| | 5'-GUCAUCAGGCUAGUCACAAAGCUca-3' | (SEQ ID NO: 240) |
| | 3'-GUCAGUAGUCCGAUCAGUGUUUCGAGU-5' | (SEQ ID NO: 555) |
| MCL1-m1492 Target: | 5'-CAGTCATCAGGCTAGTCACAAAGCTCA-3' | (SEQ ID NO: 870) |
| | 5'-GCUAGUCACAAAGCUCAAUAAAUat-3' | (SEQ ID NO: 241) |
| | 3'-UCCGAUCAGUGUUUCGAGUUAUUUAUA-5' | (SEQ ID NO: 556) |
| MCL1-m1500 Target: | 5'-AGGCTAGTCACAAAGCTCAATAAATAT-3' | (SEQ ID NO: 871) |
| | 5'-GCCCUAAUUAACAACGUUGGUGAct-3' | (SEQ ID NO: 242) |
| | 3'-UUCGGGAUUAAUUGUUGCAACCACUGA-5' | (SEQ ID NO: 557) |
| MCL1-m1556 Target: | 5'-AAGCCCTAATTAACAACGTTGGTGACT-3' | (SEQ ID NO: 872) |
| | 5'-CCUACAAGUCACCAAACGAUGACta-3' | (SEQ ID NO: 243) |
| | 3'-UUGGAUGUUCAGUGGUUUGCUACUGAU-5' | (SEQ ID NO: 558) |
| MCL1-m1601 Target: | 5'-AACCTACAAGTCACCAAACGATGACTA-3' | (SEQ ID NO: 873) |
| | 5'-CUACAAGUCACCAAACGAUGACUag-3' | (SEQ ID NO: 244) |
| | 3'-UGGAUGUUCAGUGGUUUGCUACUGAUC-5' | (SEQ ID NO: 559) |
| MCL1-m1602 Target: | 5'-ACCTACAAGTCACCAAACGATGACTAG-3' | (SEQ ID NO: 874) |
| | 5'-UCACCAAACGAUGACUAGAAGCUgc-3' | (SEQ ID NO: 245) |
| | 3'-UCAGUGGUUUGCUACUGAUCUUCGACG-5' | (SEQ ID NO: 560) |
| MCL1-m1609 Target: | 5'-AGTCACCAAACGATGACTAGAAGCTGC-3' | (SEQ ID NO: 875) |
| | 5'-CACCAAACGAUGACUAGAAGCUGca-3' | (SEQ ID NO: 246) |
| | 3'-CAGUGGUUUGCUACUGAUCUUCGACGU-5' | (SEQ ID NO: 561) |
| MCL1-m1610 Target: | 5'-GTCACCAAACGATGACTAGAAGCTGCA-3' | (SEQ ID NO: 876) |
| | 5'-ACCAAACGAUGACUAGAAGCUGCag-3' | (SEQ ID NO: 247) |
| | 3'-AGUGGUUUGCUACUGAUCUUCGACGUC-5' | (SEQ ID NO: 562) |
| MCL1-m1611 Target: | 5'-TCACCAAACGATGACTAGAAGCTGCAG-3' | (SEQ ID NO: 877) |
| | 5'-CCAAACGAUGACUAGAAGCUGCAgt-3' | (SEQ ID NO: 248) |
| | 3'-GUGGUUUGCUACUGAUCUUCGACGUCA-5' | (SEQ ID NO: 563) |
| MCL1-m1612 Target: | 5'-CACCAAACGATGACTAGAAGCTGCAGT-3' | (SEQ ID NO: 878) |
| | 5'-GGAAUGUGAAGGGAGGCCUCUGAgc-3' | (SEQ ID NO: 249) |
| | 3'-GUCCUUACACUUCCCUCCGGAGACUCG-5' | (SEQ ID NO: 564) |
| MCL1-m1645 Target: | 5'-CAGGAATGTGAAGGGAGGCCTCTGAGC-3' | (SEQ ID NO: 879) |
| | 5'-UGCUUGACAAAGUCCCAAGUGCUca-3' | (SEQ ID NO: 250) |
| | 3'-ACACGAACUGUUUCAGGGUUCACGAGU-5' | (SEQ ID NO: 565) |
| MCL1-m1681 Target: | 5'-TGTGCTTGACAAAGTCCCAAGTGCTCA-3' | (SEQ ID NO: 880) |
| | 5'-GCUUGACAAAGUCCCAAGUGCUCag-3' | (SEQ ID NO: 251) |
| | 3'-CACGAACUGUUUCAGGGUUCACGAGUC-5' | (SEQ ID NO: 566) |
| MCL1-m1682 Target: | 5'-GTGCTTGACAAAGTCCCAAGTGCTCAG-3' | (SEQ ID NO: 881) |
| | 5'-GACAAAGUCCCAAGUGCUCAGGAct-3' | (SEQ ID NO: 252) |
| | 3'-AACUGUUUCAGGGUUCACGAGUCCUGA-5' | (SEQ ID NO: 567) |
| MCL1-m1686 Target: | 5'-TTGACAAAGTCCCAAGTGCTCAGGACT-3' | (SEQ ID NO: 882) |
| | 5'-CCCUGUCUACUUUGGCUUGGUUUgg-3' | (SEQ ID NO: 253) |
| | 3'-UCGGGACAGAUGAAACCGAACCAAACC-5' | (SEQ ID NO: 568) |
| MCL1-m1716 Target: | 5'-AGCCCTGTCTACTTTGGCTTGGTTTGG-3' | (SEQ ID NO: 883) |
| | 5'-CUUAAGUUUAUUAGCCUAGUGAUgg-3' | (SEQ ID NO: 254) |
| | 3'-AAGAAUUCAAAUAAUCGGAUCACUACC-5' | (SEQ ID NO: 569) |
| MCL1-m1747 Target: | 5'-TTCTTAAGTTTATTAGCCTAGTGATGG-3' | (SEQ ID NO: 884) |
| | 5'-AGUACUUGACUUAAGGUUCACUAat-3' | (SEQ ID NO: 255) |
| | 3'-UUUCAUGAACUGAAUUCCAAGUGAUUA-5' | (SEQ ID NO: 570) |
| MCL1-m1778 Target: | 5'-AAAGTACTTGACTTAAGGTTCACTAAT-3' | (SEQ ID NO: 885) |

TABLE 4-continued

Selected Mouse Anti-MCL1 DsiRNAs (Asymmetrics)

| | | |
|---|---|---|
| | 5'-ACAUAAGAGGGAAGUCUUGGAUUta-3' | (SEQ ID NO: 256) |
| | 3'-CUUGUAUUCUCCCUUCAGAACCUAAAU-5' | (SEQ ID NO: 571) |
| MCL1-m1902 Target: | 5'-GAACATAAGAGGGAAGTCTTGGATTTA-3' | (SEQ ID NO: 886) |
| | 5'-GCUUCUCUAGUUAGAAAUGUAUUtc-3' | (SEQ ID NO: 257) |
| | 3'-GUCGAAGAGAUCAAUCUUUACAUAAAG-5' | (SEQ ID NO: 572) |
| MCL1-m1957 Target: | 5'-CAGCTTCTCTAGTTAGAAATGTATTTC-3' | (SEQ ID NO: 887) |
| | 5'-UCAUCCGUUCUAGUGUAUAUGCAga-3' | (SEQ ID NO: 258) |
| | 3'-ACAGUAGGCAAGAUCACAUAUACGUCU-5' | (SEQ ID NO: 573) |
| MCL1-m2003 Target: | 5'-TGTCATCCGTTCTAGTGTATATGCAGA-3' | (SEQ ID NO: 888) |
| | 5'-UGUGUGGACUGGUUAUAGAUUUAta-3' | (SEQ ID NO: 259) |
| | 3'-ACACACACCUGACCAAUAUCUAAAUAU-5' | (SEQ ID NO: 574) |
| MCL1-m2038 Target: | 5'-TGTGTGTGGACTGGTTATAGATTTATA-3' | (SEQ ID NO: 889) |
| | 5'-ACUAUGCAGGGUUAAUUAUCCAAtc-3' | (SEQ ID NO: 260) |
| | 3'-AUUGAUACGUCCCAAUUAAUAGGUUAG-5' | (SEQ ID NO: 575) |
| MCL1-m2063 Target: | 5'-TAACTATGCAGGGTTAATTATCCAATC-3' | (SEQ ID NO: 890) |
| | 5'-CACAGGUAGAUAGAUGUAAGACAtt-3' | (SEQ ID NO: 261) |
| | 3'-UAGUGUCCAUCUAUCUACAUUCUGUAA-5' | (SEQ ID NO: 576) |
| MCL1-m2110 Target: | 5'-ATCACAGGTAGATAGATGTAAGACATT-3' | (SEQ ID NO: 891) |
| | 5'-GUAGAUAGAUGUAAGACAUUUGAtc-3' | (SEQ ID NO: 262) |
| | 3'-UCCAUCUAUCUACAUUCUGUAAACUAG-5' | (SEQ ID NO: 577) |
| MCL1-m2115 Target: | 5'-AGGTAGATAGATGTAAGACATTTGATC-3' | (SEQ ID NO: 892) |
| | 5'-AAAUGGUAAAGCAGGCUAGAGUCtt-3' | (SEQ ID NO: 263) |
| | 3'-CAUUUACCAUUUCGUCCGAUCUCAGAA-5' | (SEQ ID NO: 578) |
| MCL1-m2162 Target: | 5'-GTAAATGGTAAAGCAGGCTAGAGTCTT-3' | (SEQ ID NO: 893) |
| | 5'-GGUGCUAUUCACUGGGUUUACUUgt-3' | (SEQ ID NO: 264) |
| | 3'-UACCACGAUAAGUGACCCAAAUGAACA-5' | (SEQ ID NO: 579) |
| MCL1-m2193 Target: | 5'-ATGGTGCTATTCACTGGGTTTACTTGT-3' | (SEQ ID NO: 894) |
| | 5'-UCUUGUCUACUAAGGAUUGCCAAgc-3' | (SEQ ID NO: 265) |
| | 3'-AAAGAACAGAUGAUUCCUAACGGUUCG-5' | (SEQ ID NO: 580) |
| MCL1-m2262 Target: | 5'-TTTCTTGTCTACTAAGGATTGCCAAGC-3' | (SEQ ID NO: 895) |
| | 5'-GUCUCUAGGUGUAGCCUUUACUUcc-3' | (SEQ ID NO: 266) |
| | 3'-ACCAGAGAUCCACAUCGGAAAUGAAGG-5' | (SEQ ID NO: 581) |
| MCL1-m2309 Target: | 5'-TGGTCTCTAGGTGTAGCCTTTACTTCC-3' | (SEQ ID NO: 896) |
| | 5'-CUAUAGAGUCGUCUACACUUCCUcc-3' | (SEQ ID NO: 267) |
| | 3'-GGGAUAUCUCAGCAGAUGUGAAGGAGG-5' | (SEQ ID NO: 582) |
| MCL1-m2366 Target: | 5'-CCCTATAGAGTCGTCTACACTTCCTCC-3' | (SEQ ID NO: 897) |
| | 5'-CGUCUACACUUCCUCCCUGUGCUct-3' | (SEQ ID NO: 268) |
| | 3'-CAGCAGAUGUGAAGGAGGGACACGAGA-5' | (SEQ ID NO: 583) |
| MCL1-m2375 Target: | 5'-GTCGTCTACACTTCCTCCCTGTGCTCT-3' | (SEQ ID NO: 898) |
| | 5'-GUUAUCUGCAUUAGAACUCUCACcc-3' | (SEQ ID NO: 269) |
| | 3'-AUCAAUAGACGUAAUCUUGAGAGUGGG-5' | (SEQ ID NO: 584) |
| MCL1-m2415 Target: | 5'-TAGTTATCTGCATTAGAACTCTCACCC-3' | (SEQ ID NO: 899) |
| | 5'-CCUAAUCAGAGUCAGCACAGCUUtc-3' | (SEQ ID NO: 270) |
| | 3'-UAGGAUUAGUCUCAGUCGUGUCGAAAG-5' | (SEQ ID NO: 585) |
| MCL1-m2482 Target: | 5'-ATCCTAATCAGAGTCAGCACAGCTTTC-3' | (SEQ ID NO: 900) |
| | 5'-AGCUUUCCUGUCAGAGGAUAGGAac-3' | (SEQ ID NO: 271) |
| | 3'-UGUCGAAAGGACAGUCUCCUAUCCUUG-5' | (SEQ ID NO: 586) |
| MCL1-m2500 Target: | 5'-ACAGCTTTCCTGTCAGAGGATAGGAAC-3' | (SEQ ID NO: 901) |
| | 5'-CCUGUCAGAGGAUAGGAACACUUgc-3' | (SEQ ID NO: 272) |
| | 3'-AAGGACAGUCUCCUAUCCUUGUGAACG-5' | (SEQ ID NO: 587) |
| MCL1-m2506 Target: | 5'-TTCCTGTCAGAGGATAGGAACACTTGC-3' | (SEQ ID NO: 902) |
| | 5'-GUCAGAGGAUAGGAACACUUGCUct-3' | (SEQ ID NO: 273) |
| | 3'-GACAGUCUCCUAUCCUUGUGAACGAGA-5' | (SEQ ID NO: 588) |
| MCL1-m2509 Target: | 5'-CTGTCAGAGGATAGGAACACTTGCTCT-3' | (SEQ ID NO: 903) |
| | 5'-UCAGAGGAUAGGAACACUUGCUCtt-3' | (SEQ ID NO: 274) |
| | 3'-ACAGUCUCCUAUCCUUGUGAACGAGAA-5' | (SEQ ID NO: 589) |
| MCL1-m2510 Target: | 5'-TGTCAGAGGATAGGAACACTTGCTCTT-3' | (SEQ ID NO: 904) |

TABLE 4-continued

Selected Mouse Anti-MCL1 DsiRNAs (Asymmetrics)

|  |  |  |
|---|---|---|
|  | 5'-CCGACAGUGACCAGGGAUUGGCAtt-3' | (SEQ ID NO: 275) |
|  | 3'-CUGGCUGUCACUGGUCCCUAACCGUAA-5' | (SEQ ID NO: 590) |
| MCL1-m2547 Target: | 5'-GACCGACAGTGACCAGGGATTGGCATT-3' | (SEQ ID NO: 905) |
|  | 5'-UGCUUUCCAUUGUUACUUUGUCUat-3' | (SEQ ID NO: 276) |
|  | 3'-GUACGAAAGGUAACAAUGAAACAGAUA-5' | (SEQ ID NO: 591) |
| MCL1-m2584 Target: | 5'-CATGCTTTCCATTGTTACTTTGTCTAT-3' | (SEQ ID NO: 906) |
|  | 5'-GGUUGGAAAUUAUACGUUUAUACtt-3' | (SEQ ID NO: 277) |
|  | 3'-UUCCAACCUUUAAUAUGCAAAUAUGAA-5' | (SEQ ID NO: 592) |
| MCL1-m2651 Target: | 5'-AAGGTTGGAAATTATACGTTTATACTT-3' | (SEQ ID NO: 907) |
|  | 5'-AUUAGUUUGCUCCAAGUAUGACUgt-3' | (SEQ ID NO: 278) |
|  | 3'-AAUAAUCAAACGAGGUUCAUACUGACA-5' | (SEQ ID NO: 593) |
| MCL1-m2678 Target: | 5'-TTATTAGTTTGCTCCAAGTATGACTGT-3' | (SEQ ID NO: 908) |
|  | 5'-CACUUAAGUUUAGAGAAACACUGgg-3' | (SEQ ID NO: 279) |
|  | 3'-AAGUGAAUUCAAAUCUCUUUGUGACCC-5' | (SEQ ID NO: 594) |
| MCL1-m2706 Target: | 5'-TTCACTTAAGTTTAGAGAAACACTGGG-3' | (SEQ ID NO: 909) |
|  | 5'-ACUGGUAACUGAAGGUAUUUAAGct-3' | (SEQ ID NO: 280) |
|  | 3'-GGUGACCAUUGACUUCCAUAAAUUCGA-5' | (SEQ ID NO: 595) |
| MCL1-m2758 Target: | 5'-CCACTGGTAACTGAAGGTATTTAAGCT-3' | (SEQ ID NO: 910) |
|  | 5'-GCCUCAGAAUGUGACCUUUAGUCag-3' | (SEQ ID NO: 281) |
|  | 3'-GUCGGAGUCUUACACUGGAAAUCAGUC-5' | (SEQ ID NO: 596) |
| MCL1-m2803 Target: | 5'-CAGCCTCAGAATGTGACCTTTAGTCAG-3' | (SEQ ID NO: 911) |
|  | 5'-UAGGCAGGAAUCAAAUGACUAAGaa-3' | (SEQ ID NO: 282) |
|  | 3'-UUAUCCGUCCUUAGUUUACUGAUUCUU-5' | (SEQ ID NO: 597) |
| MCL1-m2843 Target: | 5'-AATAGGCAGGAATCAAATGACTAAGAA-3' | (SEQ ID NO: 912) |
|  | 5'-AGGCAGGAAUCAAAUGACUAAGAat-3' | (SEQ ID NO: 283) |
|  | 3'-UAUCCGUCCUUAGUUUACUGAUUCUUA-5' | (SEQ ID NO: 598) |
| MCL1-m2844 Target: | 5'-ATAGGCAGGAATCAAATGACTAAGAAT-3' | (SEQ ID NO: 913) |
|  | 5'-GGCAGGAAUCAAAUGACUAAGAAtg-3' | (SEQ ID NO: 284) |
|  | 3'-AUCCGUCCUUAGUUUACUGAUUCUUAC-5' | (SEQ ID NO: 599) |
| MCL1-m2845 Target: | 5'-TAGGCAGGAATCAAATGACTAAGAATG-3' | (SEQ ID NO: 914) |
|  | 5'-GCAGGAAUCAAAUGACUAAGAAUgt-3' | (SEQ ID NO: 285) |
|  | 3'-UCCGUCCUUAGUUUACUGAUUCUUACA-5' | (SEQ ID NO: 600) |
| MCL1-m2846 Target: | 5'-AGGCAGGAATCAAATGACTAAGAATGT-3' | (SEQ ID NO: 915) |
|  | 5'-CAGGAAUCAAAUGACUAAGAAUGta-3' | (SEQ ID NO: 286) |
|  | 3'-CCGUCCUUAGUUUACUGAUUCUUACAU-5' | (SEQ ID NO: 601) |
| MCL1-m2847 Target: | 5'-GGCAGGAATCAAATGACTAAGAATGTA-3' | (SEQ ID NO: 916) |
|  | 5'-AGGAAUCAAAUGACUAAGAAUGUaa-3' | (SEQ ID NO: 287) |
|  | 3'-CGUCCUUAGUUUACUGAUUCUUACAUU-5' | (SEQ ID NO: 602) |
| MCL1-m2848 Target: | 5'-GCAGGAATCAAATGACTAAGAATGTAA-3' | (SEQ ID NO: 917) |
|  | 5'-GGAAUCAAAUGACUAAGAAUGUAat-3' | (SEQ ID NO: 288) |
|  | 3'-GUCCUUAGUUUACUGAUUCUUACAUUA-5' | (SEQ ID NO: 603) |
| MCL1-m2849 Target: | 5'-CAGGAATCAAATGACTAAGAATGTAAT-3' | (SEQ ID NO: 918) |
|  | 5'-GAAUCAAAUGACUAAGAAUGUAAta-3' | (SEQ ID NO: 289) |
|  | 3'-UCCUUAGUUUACUGAUUCUUACAUUAU-5' | (SEQ ID NO: 604) |
| MCL1-m2850 Target: | 5'-AGGAATCAAATGACTAAGAATGTAATA-3' | (SEQ ID NO: 919) |
|  | 5'-GACUAAGAAUGUAAUAGGGAAGAag-3' | (SEQ ID NO: 290) |
|  | 3'-UACUGAUUCUUACAUUAUCCCUUCUUC-5' | (SEQ ID NO: 605) |
| MCL1-m2859 Target: | 5'-ATGACTAAGAATGTAATAGGGAAGAAG-3' | (SEQ ID NO: 920) |
|  | 5'-GCCAGCUUGGGAGUGAUUUGUACct-3' | (SEQ ID NO: 291) |
|  | 3'-GACGGUCGAACCCUCACUAAACAUGGA-5' | (SEQ ID NO: 606) |
| MCL1-m2894 Target: | 5'-CTGCCAGCTTGGGAGTGATTTGTACCT-3' | (SEQ ID NO: 921) |
|  | 5'-CCUUGAUCAUAGUUUGCUUAUUUat-3' | (SEQ ID NO: 292) |
|  | 3'-UAGGAACUAGUAUCAAACGAAUAAAUA-5' | (SEQ ID NO: 607) |
| MCL1-m2929 Target: | 5'-ATCCTTGATCATAGTTTGCTTATTTAT-3' | (SEQ ID NO: 922) |
|  | 5'-AGCACUUUAUGUAGUUGAAUAAAcc-3' | (SEQ ID NO: 293) |
|  | 3'-UCUCGUGAAAUACAUCAACUUAUUUGG-5' | (SEQ ID NO: 608) |
| MCL1-m2975 Target: | 5'-AGAGCACTTTATGTAGTTGAATAAACC-3' | (SEQ ID NO: 923) |

TABLE 4-continued

Selected Mouse Anti-MCL1 DsiRNAs (Asymmetrics)

|  |  |  |
|---|---|---|
|  | 5'-GCACUUUAUGUAGUUGAAUAAACcc-3' | (SEQ ID NO: 294) |
|  | 3'-CUCGUGAAAUACAUCAACUUAUUGGG-5' | (SEQ ID NO: 609) |
| MCL1-m2976 Target: | 5'-GAGCACTTTATGTAGTTGAATAAACCC-3' | (SEQ ID NO: 924) |
|  | 5'-UGUUUACUAGGAGCCUGACUUCCca-3' | (SEQ ID NO: 295) |
|  | 3'-AAACAAAUGAUCCUCGGACUGAAGGGU-5' | (SEQ ID NO: 610) |
| MCL1-m3055 Target: | 5'-TTTGTTTACTAGGAGCCTGACTTCCCA-3' | (SEQ ID NO: 925) |
|  | 5'-CCUGACUUCCCAGCUCACAAAGGgt-3' | (SEQ ID NO: 296) |
|  | 3'-UCGGACUGAAGGGUCGAGUGUUUCCCA-5' | (SEQ ID NO: 611) |
| MCL1-m3068 Target: | 5'-AGCCTGACTTCCCAGCTCACAAAGGGT-3' | (SEQ ID NO: 926) |
|  | 5'-CUGACUUCCCAGCUCACAAAGGGtg-3' | (SEQ ID NO: 297) |
|  | 3'-CGGACUGAAGGGUCGAGUGUUUCCCAC-5' | (SEQ ID NO: 612) |
| MCL1-m3069 Target: | 5'-GCCTGACTTCCCAGCTCACAAAGGGTG-3' | (SEQ ID NO: 927) |
|  | 5'-UGACUUCCCAGCUCACAAAGGGUga-3' | (SEQ ID NO: 298) |
|  | 3'-GGACUGAAGGGUCGAGUGUUUCCCACU-5' | (SEQ ID NO: 613) |
| MCL1-m3070 Target: | 5'-CCTGACTTCCCAGCTCACAAAGGGTGA-3' | (SEQ ID NO: 928) |
|  | 5'-CCAGCUCACAAAGGGUGAAAUGAaa-3' | (SEQ ID NO: 299) |
|  | 3'-AGGGUCGAGUGUUUCCCACUUUACUUU-5' | (SEQ ID NO: 614) |
| MCL1-m3077 Target: | 5'-TCCCAGCTCACAAAGGGTGAAATGAAA-3' | (SEQ ID NO: 929) |
|  | 5'-CUCACAAAGGGUGAAAUGAAAGCtg-3' | (SEQ ID NO: 300) |
|  | 3'-UCGAGUGUUUCCCACUUUACUUUCGAC-5' | (SEQ ID NO: 615) |
| MCL1-m3081 Target: | 5'-AGCTCACAAAGGGTGAAATGAAAGCTG-3' | (SEQ ID NO: 930) |
|  | 5'-UGAAGUACAGACAGGAUCUUAGUag-3' | (SEQ ID NO: 301) |
|  | 3'-CGACUUCAUGUCUGUCCUAGAAUCAUC-5' | (SEQ ID NO: 616) |
| MCL1-m3104 Target: | 5'-GCTGAAGTACAGACAGGATCTTAGTAG-3' | (SEQ ID NO: 931) |
|  | 5'-AGUACAGACAGGAUCUUAGUAGGta-3' | (SEQ ID NO: 302) |
|  | 3'-CUUCAUGUCUGUCCUAGAAUCAUCCAU-5' | (SEQ ID NO: 617) |
| MCL1-m3107 Target: | 5'-GAAGTACAGACAGGATCTTAGTAGGTA-3' | (SEQ ID NO: 932) |
|  | 5'-GCCAUGAAGACUUGGAGAGCGCAgt-3' | (SEQ ID NO: 303) |
|  | 3'-CCCGGUACUUCUGAACCUCUCGCGUCA-5' | (SEQ ID NO: 618) |
| MCL1-m3145 Target: | 5'-GGGCCATGAAGACTTGGAGAGCGCAGT-3' | (SEQ ID NO: 933) |
|  | 5'-UUGGAGGGAAGAAGCAUGUGGUCtg-3' | (SEQ ID NO: 304) |
|  | 3'-GAAACCUCCCUUCUUCGUACACCAGAC-5' | (SEQ ID NO: 619) |
| MCL1-m3189 Target: | 5'-CTTTGGAGGGAAGAAGCATGTGGTCTG-3' | (SEQ ID NO: 934) |
|  | 5'-AGUGCUGACUAGAUGAAUAGUUGag-3' | (SEQ ID NO: 305) |
|  | 3'-ACUCACGACUGAUCUACUUAUCAACUC-5' | (SEQ ID NO: 620) |
| MCL1-m3214 Target: | 5'-TGAGTGCTGACTAGATGAATAGTTGAG-3' | (SEQ ID NO: 935) |
|  | 5'-UGACUAGAUGAAUAGUUGAGGCAca-3' | (SEQ ID NO: 306) |
|  | 3'-CGACUGAUCUACUUAUCAACUCCGUGU-5' | (SEQ ID NO: 621) |
| MCL1-m3219 Target: | 5'-GCTGACTAGATGAATAGTTGAGGCACA-3' | (SEQ ID NO: 936) |
|  | 5'-AGGCACAUCCUUCAGAGAAGAGGga-3' | (SEQ ID NO: 307) |
|  | 3'-ACUCCGUGUAGGAAGUCUCUUCUCCCU-5' | (SEQ ID NO: 622) |
| MCL1-m3237 Target: | 5'-TGAGGCACATCCTTCAGAGAAGAGGGA-3' | (SEQ ID NO: 937) |
|  | 5'-GGCACAUCCUUCAGAGAAGAGGGag-3' | (SEQ ID NO: 308) |
|  | 3'-CUCCGUGUAGGAAGUCUCUUCUCCCUC-5' | (SEQ ID NO: 623) |
| MCL1-m3238 Target: | 5'-GAGGCACATCCTTCAGAGAAGAGGGAG-3' | (SEQ ID NO: 938) |
|  | 5'-GCUGCUUGGAAAGAUGGCUCUCAgc-3' | (SEQ ID NO: 309) |
|  | 3'-CCCGACGAACCUUUCUACCGAGAGUCG-5' | (SEQ ID NO: 624) |
| MCL1-m3265 Target: | 5'-GGGCTGCTTGGAAAGATGGCTCTCAGC-3' | (SEQ ID NO: 939) |
|  | 5'-UCUGUUUGUCUUACACGUCUCUCag-3' | (SEQ ID NO: 310) |
|  | 3'-UUAGACAAACAGAAUGUGCAGAGAGUC-5' | (SEQ ID NO: 625) |
| MCL1-m3294 Target: | 5'-AATCTGTTTGTCTTACACGTCTCTCAG-3' | (SEQ ID NO: 940) |
|  | 5'-AGCAUCUUCCAUGUACAUUCUAUct-3' | (SEQ ID NO: 311) |
|  | 3'-GUUCGUAGAAGGUACAUGUAAGAUAGA-5' | (SEQ ID NO: 626) |
| MCL1-m3340 Target: | 5'-CAAGCATCTTCCATGTACATTCTATCT-3' | (SEQ ID NO: 941) |
|  | 5'-GCACCUAACACUUUAACAGCUGUtc-3' | (SEQ ID NO: 312) |
|  | 3'-CUCGUGGAUUGUGAAAUUGUCGACAAG-5' | (SEQ ID NO: 627) |
| MCL1-m3390 Target: | 5'-GAGCACCTAACACTTTAACAGCTGTTC-3' | (SEQ ID NO: 942) |

TABLE 4-continued

Selected Mouse Anti-MCL1 DsiRNAs (Asymmetrics)

| | | |
|---|---|---|
| MCL1-m3407 Target: | 5'-AGCUGUUCCCGAAAGGGUUAGGAcc-3'<br>3'-UGUCGACAAGGGCUUUCCCAAUCCUGG-5'<br>5'-ACAGCTGTTCCCGAAAGGGTTAGGACC-3' | (SEQ ID NO: 313)<br>(SEQ ID NO: 628)<br>(SEQ ID NO: 943) |
| MCL1-m3416 Target: | 5'-CGAAAGGGUUAGGACCAACUGCAag-3'<br>3'-GGGCUUUCCCAAUCCUGGUUGACGUUC-5'<br>5'-CCCGAAAGGGTTAGGACCAACTGCAAG-3' | (SEQ ID NO: 314)<br>(SEQ ID NO: 629)<br>(SEQ ID NO: 944) |
| MCL1-m3430 Target: | 5'-CCAACUGCAAGUUAAUGUGGGUUgt-3'<br>3'-CUGGUUGACGUUCAAUUACACCCAACA-5'<br>5'-GACCAACTGCAAGTTAATGTGGGTTGT-3' | (SEQ ID NO: 315)<br>(SEQ ID NO: 630)<br>(SEQ ID NO: 945) |
| MCL1-m1355 Target: | 5'-CUGGAAGAGUCACUGUCUGAAUGaa-3'<br>3'-GGGACCUUCUCAGUGACAGACUUACUU-5'<br>5'-CCCTGGAAGAGTCACTGTCTGAATGAA-3' | (SEQ ID NO: 2301)<br>(SEQ ID NO: 2397)<br>(SEQ ID NO: 2493) |

TABLE 5

Selected Mouse Anti-MCL1 DsiRNAs, Unmodified Duplexes (Asymmetrics)

| | | |
|---|---|---|
| MCL1-m69 Target: | 5'-GGAACGGCCUUCCUCACUCCUGACU-3'<br>3'-UCCCUUGCCGGAAGGAGUGAGGACUGA-5'<br>5'-AGGGAACGGCCTTCCTCACTCCTGACT-3' | (SEQ ID NO: 1146)<br>(SEQ ID NO: 516)<br>(SEQ ID NO: 831) |
| MCL1-m172 Target: | 5'-GCGGAGAAACGCGGUCAUCGGCUUG-3'<br>3'-GACGCCUCUUUGCGCCAGUAGCCGAAC-5'<br>5'-CTGCGGAGAAACGCGGTCATCGGCTTG-3' | (SEQ ID NO: 1147)<br>(SEQ ID NO: 517)<br>(SEQ ID NO: 832) |
| MCL1-m469 Target: | 5'-GGAGGAGGAACUGGACGGCUGCGAG-3'<br>3'-GGCCUCCUCCUUGACCUGCCGACGCUC-5'<br>5'-CCGGAGGAGGAACTGGACGGCTGCGAG-3' | (SEQ ID NO: 1148)<br>(SEQ ID NO: 518)<br>(SEQ ID NO: 833) |
| MCL1-m606 Target: | 5'-AGGAGGAAGAGGACGACCUAUACCG-3'<br>3'-GCUCCUCCUUCUCCUGCUGGAUAUGGC-5'<br>5'-CGAGGAGGAAGAGGACGACCTATACCG-3' | (SEQ ID NO: 1149)<br>(SEQ ID NO: 519)<br>(SEQ ID NO: 834) |
| MCL1-m607 Target: | 5'-GGAGGAAGAGGACGACCUAUACCGC-3'<br>3'-CUCCUCCUUCUCCUGCUGGAUAUGGCG-5'<br>5'-GAGGAGGAAGAGGACGACCTATACCGC-3' | (SEQ ID NO: 1150)<br>(SEQ ID NO: 520)<br>(SEQ ID NO: 835) |
| MCL1-m608 Target: | 5'-GAGGAAGAGGACGACCUAUACCGCC-3'<br>3'-UCCUCCUUCUCCUGCUGGAUAUGGCGG-5'<br>5'-AGGAGGAAGAGGACGACCTATACCGCC-3' | (SEQ ID NO: 1151)<br>(SEQ ID NO: 521)<br>(SEQ ID NO: 836) |
| MCL1-m610 Target: | 5'-GGAAGAGGACGACCUAUACCGCCAG-3'<br>3'-CUCCUUCUCCUGCUGGAUAUGGCGGUC-5'<br>5'-GAGGAAGAGGACGACCTATACCGCCAG-3' | (SEQ ID NO: 1152)<br>(SEQ ID NO: 522)<br>(SEQ ID NO: 837) |
| MCL1-m891 Target: | 5'-GGAUUGUGACUCUUAUUUCUUUCGG-3'<br>3'-GUCCUAACACUGAGAAUAAAGAAAGCC-5'<br>5'-CAGGATTGTGACTCTTATTTCTTTCGG-3' | (SEQ ID NO: 1153)<br>(SEQ ID NO: 523)<br>(SEQ ID NO: 838) |
| MCL1-m924 Target: | 5'-UGGCCAAACACUUAAAGAGCGUAAA-3'<br>3'-ACACCGUUUGUGAAUUUCUCGCAUUU-5'<br>5'-TGTGGCCAAACACTTAAAGAGCGTAAA-3' | (SEQ ID NO: 1154)<br>(SEQ ID NO: 524)<br>(SEQ ID NO: 839) |
| MCL1-m925 Target: | 5'-GGCCAAACACUUAAAGAGCGUAAAC-3'<br>3'-CACCGUUUGUGAAUUUCUCGCAUUUG-5'<br>5'-GTGGCCAAACACTTAAAGAGCGTAAAC-3' | (SEQ ID NO: 1155)<br>(SEQ ID NO: 525)<br>(SEQ ID NO: 840) |
| MCL1-m926 Target: | 5'-GCCAAACACUUAAAGAGCGUAAACC-3'<br>3'-ACCGGUUUGUGAAUUUCUCGCAUUUGG-5'<br>5'-TGGCCAAACACTTAAAGAGCGTAAACC-3' | (SEQ ID NO: 1156)<br>(SEQ ID NO: 526)<br>(SEQ ID NO: 841) |
| MCL1-m939 Target: | 5'-AGAGCGUAAACCAAGAAAGCUUCAU-3'<br>3'-UUUCUCGCAUUUGGUUCUUUCGAAGUA-5'<br>5'-AAAGAGCGTAAACCAAGAAAGCTTCAT-3' | (SEQ ID NO: 1157)<br>(SEQ ID NO: 527)<br>(SEQ ID NO: 842) |
| MCL1-m966 Target: | 5'-AACCAUUAGCAGAAACUAUCACAGA-3'<br>3'-GCUUGGUAAUCGUCUUUGAUAGUGUCU-5'<br>5'-CGAACCATTAGCAGAAACTATCACAGA-3' | (SEQ ID NO: 1158)<br>(SEQ ID NO: 528)<br>(SEQ ID NO: 843) |
| MCL1-m973 Target: | 5'-AGCAGAAACUAUCACAGAUGUUCUU-3'<br>3'-AAUCGUCUUUGAUAGUGUCUACAAGAA-5'<br>5'-TTAGCAGAAACTATCACAGATGTTCTT-3' | (SEQ ID NO: 1159)<br>(SEQ ID NO: 529)<br>(SEQ ID NO: 844) |

TABLE 5-continued

Selected Mouse Anti-MCL1 DsiRNAs, Unmodified Duplexes (Asymmetrics)

| | | |
|---|---|---|
| | 5'-GGGACUGGCUUGUCAAACAAAGAGG-3' | (SEQ ID NO: 1160) |
| | 3'-UGCCCUGACCGAACAGUUUGUUUCUCC-5' | (SEQ ID NO: 530) |
| MCL1-m1011 Target: | 5'-ACGGGACTGGCTTGTCAAACAAAGAGG-3' | (SEQ ID NO: 845) |
| | 5'-GGACUGGCUUGUCAAACAAAGAGGC-3' | (SEQ ID NO: 1161) |
| | 3'-GCCCUGACCGAACAGUUUGUUUCUCCG-5' | (SEQ ID NO: 531) |
| MCL1-m1012 Target: | 5'-CGGGACTGGCTTGTCAAACAAAGAGGC-3' | (SEQ ID NO: 846) |
| | 5'-GUGGAGUUCUUCCACGUACAGGACC-3' | (SEQ ID NO: 1162) |
| | 3'-AACACCUCAAGAAGGUGCAUGUCCUGG-5' | (SEQ ID NO: 532) |
| MCL1-m1049 Target: | 5'-TTGTGGAGTTCTTCCACGTACAGGACC-3' | (SEQ ID NO: 847) |
| | 5'-AGUUCUUCCACGUACAGGACCUAGA-3' | (SEQ ID NO: 1163) |
| | 3'-CCUCAAGAAGGUGCAUGUCCUGGAUCU-5' | (SEQ ID NO: 533) |
| MCL1-m1053 Target: | 5'-GGAGTTCTTCCACGTACAGGACCTAGA-3' | (SEQ ID NO: 848) |
| | 5'-CCACGUACAGGACCUAGAAGGCGGC-3' | (SEQ ID NO: 1164) |
| | 3'-AAGGUGCAUGUCCUGGAUCUUCCGCCG-5' | (SEQ ID NO: 534) |
| MCL1-m1060 Target: | 5'-TTCCACGTACAGGACCTAGAAGGCGGC-3' | (SEQ ID NO: 849) |
| | 5'-GGUCUGGCAUAUCUAAUAAGAUAGC-3' | (SEQ ID NO: 1165) |
| | 3'-GACCAGACCGUAUAGAUUAUUCUAUCG-5' | (SEQ ID NO: 535) |
| MCL1-m1133 Target: | 5'-CTGGTCTGGCATATCTAATAAGATAGC-3' | (SEQ ID NO: 850) |
| | 5'-CCACCAAACUACAUGCAUCUGUGAA-3' | (SEQ ID NO: 1166) |
| | 3'-UCGGUGGUUUGAUGUACGUAGACACUU-5' | (SEQ ID NO: 536) |
| MCL1-m1193 Target: | 5'-AGCCACCAAACTACATGCATCTGTGAA-3' | (SEQ ID NO: 851) |
| | 5'-UGUGUAUUUAUGAAGGUGGACUUGA-3' | (SEQ ID NO: 1167) |
| | 3'-GUACACAUAAAUACUUCCACCUGAACU-5' | (SEQ ID NO: 537) |
| MCL1-m1222 Target: | 5'-CATGTGTATTTATGAAGGTGGACTTGA-3' | (SEQ ID NO: 852) |
| | 5'-UGUAUUUAUGAAGGUGGACUUGAAG-3' | (SEQ ID NO: 1168) |
| | 3'-ACACAUAAAUACUUCCACCUGAACUUC-5' | (SEQ ID NO: 538) |
| MCL1-m1224 Target: | 5'-TGTGTATTTATGAAGGTGGACTTGAAG-3' | (SEQ ID NO: 853) |
| | 5'-AUUUAUGAAGGUGGACUUGAAGCUG-3' | (SEQ ID NO: 1169) |
| | 3'-CAUAAAUACUUCCACCUGAACUUCGAC-5' | (SEQ ID NO: 539) |
| MCL1-m1227 Target: | 5'-GTATTTATGAAGGTGGACTTGAAGCTG-3' | (SEQ ID NO: 854) |
| | 5'-CCAGUUCUACUGUAGCAACAUAGCA-3' | (SEQ ID NO: 1170) |
| | 3'-CAGGUCAAGAUGACAUCGUUGUAUCGU-5' | (SEQ ID NO: 540) |
| MCL1-m1269 Target: | 5'-GTCCAGTTCTACTGTAGCAACATAGCA-3' | (SEQ ID NO: 855) |
| | 5'-CUGGAAGAGUCACUGUCUGAAUGAA-3' | (SEQ ID NO: 1171) |
| | 3'-GGGACCUUCUCAGUGACAGACUUACUU-5' | (SEQ ID NO: 541) |
| MCL1-m1355 Target: | 5'-CCCTGGAAGAGTCACTGTCTGAATGAA-3' | (SEQ ID NO: 856) |
| | 5'-UGGAAGAGUCACUGUCUGAAUGAAG-3' | (SEQ ID NO: 1172) |
| | 3'-GGACCUUCUCAGUGACAGACUUACUUC-5' | (SEQ ID NO: 542) |
| MCL1-m1356 Target: | 5'-CCTGGAAGAGTCACTGTCTGAATGAAG-3' | (SEQ ID NO: 857) |
| | 5'-GGAAGAGUCACUGUCUGAAUGAAGC-3' | (SEQ ID NO: 1173) |
| | 3'-GACCUUCUCAGUGACAGACUUACUUCG-5' | (SEQ ID NO: 543) |
| MCL1-m1357 Target: | 5'-CTGGAAGAGTCACTGTCTGAATGAAGC-3' | (SEQ ID NO: 858) |
| | 5'-CUGUCUGAAUGAAGCAAAGUUCCCU-3' | (SEQ ID NO: 1174) |
| | 3'-GUGACAGACUUACUUCGUUUCAAGGGA-5' | (SEQ ID NO: 544) |
| MCL1-m1367 Target: | 5'-CACTGTCTGAATGAAGCAAAGTTCCCT-3' | (SEQ ID NO: 859) |
| | 5'-CCCUCUCAGCAAACACUGAGAGGCC-3' | (SEQ ID NO: 1175) |
| | 3'-AAGGGAGAGUCGUUUGUGACUCUCCGG-5' | (SEQ ID NO: 545) |
| MCL1-m1388 Target: | 5'-TTCCCTCTCAGCAAACACTGAGAGGCC-3' | (SEQ ID NO: 860) |
| | 5'-CCUCUCAGCAAACACUGAGAGGCCA-3' | (SEQ ID NO: 1176) |
| | 3'-AGGGAGAGUCGUUUGUGACUCUCCGGU-5' | (SEQ ID NO: 546) |
| MCL1-m1389 Target: | 5'-TCCCTCTCAGCAAACACTGAGAGGCCA-3' | (SEQ ID NO: 861) |
| | 5'-AGCAAACACUGAGAGGCCAUGGAGA-3' | (SEQ ID NO: 1177) |
| | 3'-AGUCGUUUGUGACUCUCCGGUACCUCU-5' | (SEQ ID NO: 547) |
| MCL1-m1395 Target: | 5'-TCAGCAAACACTGAGAGGCCATGGAGA-3' | (SEQ ID NO: 862) |
| | 5'-CACUGAGAGGCCAUGGAGAAGGACU-3' | (SEQ ID NO: 1178) |
| | 3'-UUGUGACUCUCCGGUACCUCUUCCUGA-5' | (SEQ ID NO: 548) |
| MCL1-m1401 Target: | 5'-AACACTGAGAGGCCATGGAGAAGGACT-3' | (SEQ ID NO: 863) |

TABLE 5-continued

Selected Mouse Anti-MCL1 DsiRNAs, Unmodified Duplexes (Asymmetrics)

| | | |
|---|---|---|
| | 5'-GGCCAUGGAGAAGGACUUCUAGAAU-3' | (SEQ ID NO: 1179) |
| | 3'-CUCCGGUACCUCUUCCUGAAGAUCUUA-5' | (SEQ ID NO: 549) |
| MCL1-m1409 Target: | 5'-GAGGCCATGGAGAAGGACTTCTAGAAT-3' | (SEQ ID NO: 864) |
| | 5'-GCCAUGGAGAAGGACUUCUAGAAUG-3' | (SEQ ID NO: 1180) |
| | 3'-UCCGGUACCUCUUCCUGAAGAUCUUAC-5' | (SEQ ID NO: 550) |
| MCL1-m1410 Target: | 5'-AGGCCATGGAGAAGGACTTCTAGAATG-3' | (SEQ ID NO: 865) |
| | 5'-GAGAAGGACUUCUAGAAUGAAUGAA-3' | (SEQ ID NO: 1181) |
| | 3'-ACCUCUUCCUGAAGAUCUUACUUACUU-5' | (SEQ ID NO: 551) |
| MCL1-m1416 Target: | 5'-TGGAGAAGGACTTCTAGAATGAATGAA-3' | (SEQ ID NO: 866) |
| | 5'-AGGACUUCUAGAAUGAAUGAAAGGG-3' | (SEQ ID NO: 1182) |
| | 3'-CUUCCUGAAGAUCUUACUUACUUUCCC-5' | (SEQ ID NO: 552) |
| MCL1-m1420 Target: | 5'-GAAGGACTTCTAGAATGAATGAAAGGG-3' | (SEQ ID NO: 867) |
| | 5'-GGAUGGAAAGGUUUGAUUUCCUAUC-3' | (SEQ ID NO: 1183) |
| | 3'-CACCUACCUUUCCAAACUAAAGGAUAG-5' | (SEQ ID NO: 553) |
| MCL1-m1447 Target: | 5'-GTGGATGGAAAGGTTTGATTTCCTATC-3' | (SEQ ID NO: 868) |
| | 5'-AGUCAUCAGGCUAGUCACAAAGCUC-3' | (SEQ ID NO: 1184) |
| | 3'-GGUCAGUAGUCCGAUCAGUGUUUCGAG-5' | (SEQ ID NO: 554) |
| MCL1-m1491 Target: | 5'-CCAGTCATCAGGCTAGTCACAAAGCTC-3' | (SEQ ID NO: 869) |
| | 5'-GUCAUCAGGCUAGUCACAAAGCUCA-3' | (SEQ ID NO: 1185) |
| | 3'-GUCAGUAGUCCGAUCAGUGUUUCGAGU-5' | (SEQ ID NO: 555) |
| MCL1-m1492 Target: | 5'-CAGTCATCAGGCTAGTCACAAAGCTCA-3' | (SEQ ID NO: 870) |
| | 5'-GCUAGUCACAAAGCUCAAUAAAUAU-3' | (SEQ ID NO: 1186) |
| | 3'-UCCGAUCAGUGUUUCGAGUUAUUUAUA-5' | (SEQ ID NO: 556) |
| MCL1-m1500 Target: | 5'-AGGCTAGTCACAAAGCTCAATAAATAT-3' | (SEQ ID NO: 871) |
| | 5'-GCCCUAAUUAACAACGUUGGUGACU-3' | (SEQ ID NO: 1187) |
| | 3'-UUCGGGAUUAAUUGUUGCAACCACUGA-5' | (SEQ ID NO: 557) |
| MCL1-m1556 Target: | 5'-AAGCCCTAATTAACAACGTTGGTGACT-3' | (SEQ ID NO: 872) |
| | 5'-CCUACAAGUCACCAAACGAUGACUA-3' | (SEQ ID NO: 1188) |
| | 3'-UUGGAUGUUCAGUGGUUUGCUACUGAU-5' | (SEQ ID NO: 558) |
| MCL1-m1601 Target: | 5'-AACCTACAAGTCACCAAACGATGACTA-3' | (SEQ ID NO: 873) |
| | 5'-CUACAAGUCACCAAACGAUGACUAG-3' | (SEQ ID NO: 1189) |
| | 3'-UGGAUGUUCAGUGGUUUGCUACUGAUC-5' | (SEQ ID NO: 559) |
| MCL1-m1602 Target: | 5'-ACCTACAAGTCACCAAACGATGACTAG-3' | (SEQ ID NO: 874) |
| | 5'-UCACCAAACGAUGACUAGAAGCUGC-3' | (SEQ ID NO: 1190) |
| | 3'-UCAGUGGUUUGCUACUGAUCUUCGACG-5' | (SEQ ID NO: 560) |
| MCL1-m1609 Target: | 5'-AGTCACCAAACGATGACTAGAAGCTGC-3' | (SEQ ID NO: 875) |
| | 5'-CACCAAACGAUGACUAGAAGCUGCA-3' | (SEQ ID NO: 1191) |
| | 3'-CAGUGGUUUGCUACUGAUCUUCGACGU-5' | (SEQ ID NO: 561) |
| MCL1-m1610 Target: | 5'-GTCACCAAACGATGACTAGAAGCTGCA-3' | (SEQ ID NO: 876) |
| | 5'-ACCAAACGAUGACUAGAAGCUGCAG-3' | (SEQ ID NO: 1192) |
| | 3'-AGUGGUUUGCUACUGAUCUUCGACGUC-5' | (SEQ ID NO: 562) |
| MCL1-m1611 Target: | 5'-TCACCAAACGATGACTAGAAGCTGCAG-3' | (SEQ ID NO: 877) |
| | 5'-CCAAACGAUGACUAGAAGCUGCAGU-3' | (SEQ ID NO: 1193) |
| | 3'-GUGGUUUGCUACUGAUCUUCGACGUCA-5' | (SEQ ID NO: 563) |
| MCL1-m1612 Target: | 5'-CACCAAACGATGACTAGAAGCTGCAGT-3' | (SEQ ID NO: 878) |
| | 5'-GGAAUGUGAAGGGAGGCCUCUGAGC-3' | (SEQ ID NO: 1194) |
| | 3'-GUCCUUACACUUCCCUCCGGAGACUCG-5' | (SEQ ID NO: 564) |
| MCL1-m1645 Target: | 5'-CAGGAATGTGAAGGGAGGCCTCTGAGC-3' | (SEQ ID NO: 879) |
| | 5'-UGCUUGACAAAGUCCCAAGUGCUCA-3' | (SEQ ID NO: 1195) |
| | 3'-ACACGAACUGUUUCAGGGUUCACGAGU-5' | (SEQ ID NO: 565) |
| MCL1-m1681 Target: | 5'-TGTGCTTGACAAAGTCCCAAGTGCTCA-3' | (SEQ ID NO: 880) |
| | 5'-GCUUGACAAAGUCCCAAGUGCUCAG-3' | (SEQ ID NO: 1196) |
| | 3'-CACGAACUGUUUCAGGGUUCACGAGUC-5' | (SEQ ID NO: 566) |
| MCL1-m1682 Target: | 5'-GTGCTTGACAAAGTCCCAAGTGCTCAG-3' | (SEQ ID NO: 881) |
| | 5'-GACAAAGUCCCAAGUGCUCAGGACU-3' | (SEQ ID NO: 1197) |
| | 3'-AACUGUUUCAGGGUUCACGAGUCCUGA-5' | (SEQ ID NO: 567) |
| MCL1-m1686 Target: | 5'-TTGACAAAGTCCCAAGTGCTCAGGACT-3' | (SEQ ID NO: 882) |

TABLE 5-continued

Selected Mouse Anti-MCL1 DsiRNAs, Unmodified Duplexes (Asymmetrics)

| | | |
|---|---|---|
| | 5'-CCCUGUCUACUUUGGCUUGGUUUGG-3' | (SEQ ID NO: 1198) |
| | 3'-UCGGGACAGAUGAAACCGAACCAAACC-5' | (SEQ ID NO: 568) |
| MCL1-m1716 Target: | 5'-AGCCCTGTCTACTTTGGCTTGGTTTGG-3' | (SEQ ID NO: 883) |
| | 5'-CUUAAGUUUAUUAGCCUAGUGAUGG-3' | (SEQ ID NO: 1199) |
| | 3'-AAGAAUUCAAAUAAUCGGAUCACUACC-5' | (SEQ ID NO: 569) |
| MCL1-m1747 Target: | 5'-TTCTTAAGTTTATTAGCCTAGTGATGG-3' | (SEQ ID NO: 884) |
| | 5'-AGUACUUGACUUAAGGUUCACUAAU-3' | (SEQ ID NO: 1200) |
| | 3'-UUUCAUGAACUGAAUUCCAAGUGAUUA-5' | (SEQ ID NO: 570) |
| MCL1-m1778 Target: | 5'-AAAGTACTTGACTTAAGGTTCACTAAT-3' | (SEQ ID NO: 885) |
| | 5'-ACAUAAGAGGGAAGUCUUGGAUUUA-3' | (SEQ ID NO: 1201) |
| | 3'-CUUGUAUUCUCCCUUCAGAACCUAAAU-5' | (SEQ ID NO: 571) |
| MCL1-m1902 Target: | 5'-GAACATAAGAGGGAAGTCTTGGATTTA-3' | (SEQ ID NO: 886) |
| | 5'-GCUUCUCUAGUUAGAAAUGUAUUUC-3' | (SEQ ID NO: 1202) |
| | 3'-GUCGAAGAGAUCAAUCUUUACAUAAAG-5' | (SEQ ID NO: 572) |
| MCL1-m1957 Target: | 5'-CAGCTTCTCTAGTTAGAAATGTATTTC-3' | (SEQ ID NO: 887) |
| | 5'-UCAUCCGUUCUAGUGUAUAUGCAGA-3' | (SEQ ID NO: 1203) |
| | 3'-ACAGUAGGCAAGAUCACAUAUACGUCU-5' | (SEQ ID NO: 573) |
| MCL1-m2003 Target: | 5'-TGTCATCCGTTCTAGTGTATATGCAGA-3' | (SEQ ID NO: 888) |
| | 5'-UGUGUGGACUGGUUAUAGAUUUAUA-3' | (SEQ ID NO: 1204) |
| | 3'-ACACACACCUGACCAAUAUCUAAAUAU-5' | (SEQ ID NO: 574) |
| MCL1-m2038 Target: | 5'-TGTGTGTGGACTGGTTATAGATTTATA-3' | (SEQ ID NO: 889) |
| | 5'-ACUAUGCAGGGUUAAUUAUCCAAUC-3' | (SEQ ID NO: 1205) |
| | 3'-AUUGAUACGUCCCAAUUAAUAGGUUAG-5' | (SEQ ID NO: 575) |
| MCL1-m2063 Target: | 5'-TAACTATGCAGGGTTAATTATCCAATC-3' | (SEQ ID NO: 890) |
| | 5'-CACAGGUAGAUAGAUGUAAGACAUU-3' | (SEQ ID NO: 1206) |
| | 3'-UAGUGUCCAUCUAUCUACAUUCUGUAA-5' | (SEQ ID NO: 576) |
| MCL1-m2110 Target: | 5'-ATCACAGGTAGATAGATGTAAGACATT-3' | (SEQ ID NO: 891) |
| | 5'-GUAGAUAGAUGUAAGACAUUUGAUC-3' | (SEQ ID NO: 1207) |
| | 3'-UCCAUCUAUCUACAUUCUGUAAACUAG-5' | (SEQ ID NO: 577) |
| MCL1-m2115 Target: | 5'-AGGTAGATAGATGTAAGACATTTGATC-3' | (SEQ ID NO: 892) |
| | 5'-AAAUGGUAAAGCAGGCUAGAGUCUU-3' | (SEQ ID NO: 1208) |
| | 3'-CAUUUACCAUUUCGUCCGAUCUCAGAA-5' | (SEQ ID NO: 578) |
| MCL1-m2162 Target: | 5'-GTAAATGGTAAAGCAGGCTAGAGTCTT-3' | (SEQ ID NO: 893) |
| | 5'-GGUGCUAUUCACUGGGUUUACUUGU-3' | (SEQ ID NO: 1209) |
| | 3'-UACCACGAUAAGUGACCCAAAUGAACA-5' | (SEQ ID NO: 579) |
| MCL1-m2193 Target: | 5'-ATGGTGCTATTCACTGGGTTTACTTGT-3' | (SEQ ID NO: 894) |
| | 5'-UCUUGUCUACUAAGGAUUGCCAAGC-3' | (SEQ ID NO: 1210) |
| | 3'-AAAGAACAGAUGAUUCCUAACGGUUCG-5' | (SEQ ID NO: 580) |
| MCL1-m2262 Target: | 5'-TTTCTTGTCTACTAAGGATTGCCAAGC-3' | (SEQ ID NO: 895) |
| | 5'-GUCUCUAGGUGUAGCCUUUACUUCC-3' | (SEQ ID NO: 1211) |
| | 3'-ACCAGAGAUCCACAUCGGAAAUGAAGG-5' | (SEQ ID NO: 581) |
| MCL1-m2309 Target: | 5'-TGGTCTCTAGGTGTAGCCTTTACTTCC-3' | (SEQ ID NO: 896) |
| | 5'-CUAUAGAGUCGUCUACACUUCCUCC-3' | (SEQ ID NO: 1212) |
| | 3'-GGGAUAUCUCAGCAGAUGUGAAGGAGG-5' | (SEQ ID NO: 582) |
| MCL1-m2366 Target: | 5'-CCCTATAGAGTCGTCTACACTTCCTCC-3' | (SEQ ID NO: 897) |
| | 5'-CGUCUACACUUCCUCCCUGUGCUCU-3' | (SEQ ID NO: 1213) |
| | 3'-CAGCAGAUGUGAAGGAGGGACACGAGA-5' | (SEQ ID NO: 583) |
| MCL1-m2375 Target: | 5'-GTCGTCTACACTTCCTCCCTGTGCTCT-3' | (SEQ ID NO: 898) |
| | 5'-GUUAUCUGCAUUAGAACUCUCACCC-3' | (SEQ ID NO: 1214) |
| | 3'-AUCAAUAGACGUAAUCUUGAGAGUGGG-5' | (SEQ ID NO: 584) |
| MCL1-m2415 Target: | 5'-TAGTTATCTGCATTAGAACTCTCACCC-3' | (SEQ ID NO: 899) |
| | 5'-CCUAAUCAGAGUCAGCACAGCUUUC-3' | (SEQ ID NO: 1215) |
| | 3'-UAGGAUUAGUCUCAGUCGUGUCGAAAG-5' | (SEQ ID NO: 585) |
| MCL1-m2482 Target: | 5'-ATCCTAATCAGAGTCAGCACAGCTTTC-3' | (SEQ ID NO: 900) |
| | 5'-AGCUUUCCUGUCAGAGGAUAGGAAC-3' | (SEQ ID NO: 1216) |
| | 3'-UGUCGAAAGGACAGUCUCCUAUCCUUG-5' | (SEQ ID NO: 586) |
| MCL1-m2500 Target: | 5'-ACAGCTTTCCTGTCAGAGGATAGGAAC-3' | (SEQ ID NO: 901) |

TABLE 5-continued

Selected Mouse Anti-MCL1 DsiRNAs, Unmodified Duplexes (Asymmetrics)

| | | |
|---|---|---|
| | 5'-CCUGUCAGAGGAUAGGAACACUUGC-3' | (SEQ ID NO: 1217) |
| | 3'-AAGGACAGUCUCCUAUCCUUGUGAACG-5' | (SEQ ID NO: 587) |
| MCL1-m2506 Target: | 5'-TTCCTGTCAGAGGATAGGAACACTTGC-3' | (SEQ ID NO: 902) |
| | 5'-GUCAGAGGAUAGGAACACUUGCUCU-3' | (SEQ ID NO: 1218) |
| | 3'-GACAGUCUCCUAUCCUUGUGAACGAGA-5' | (SEQ ID NO: 588) |
| MCL1-m2509 Target: | 5'-CTGTCAGAGGATAGGAACACTTGCTCT-3' | (SEQ ID NO: 903) |
| | 5'-UCAGAGGAUAGGAACACUUGCUCUU-3' | (SEQ ID NO: 1219) |
| | 3'-ACAGUCUCCUAUCCUUGUGAACGAGAA-5' | (SEQ ID NO: 589) |
| MCL1-m2510 Target: | 5'-TGTCAGAGGATAGGAACACTTGCTCTT-3' | (SEQ ID NO: 904) |
| | 5'-CCGACAGUGACCAGGGAUUGGCAUU-3' | (SEQ ID NO: 1220) |
| | 3'-CUGGCUGUCACUGGUCCCUAACCGUAA-5' | (SEQ ID NO: 590) |
| MCL1-m2547 Target: | 5'-GACCGACAGTGACCAGGGATTGGCATT-3' | (SEQ ID NO: 905) |
| | 5'-UGCUUUCCAUUGUUACUUUGUCUAU-3' | (SEQ ID NO: 1221) |
| | 3'-GUACGAAAGGUAACAAUGAAACAGAUA-5' | (SEQ ID NO: 591) |
| MCL1-m2584 Target: | 5'-CATGCTTTCCATTGTTACTTTGTCTAT-3' | (SEQ ID NO: 906) |
| | 5'-GGUUGGAAAUUAUACGUUUAUACUU-3' | (SEQ ID NO: 1222) |
| | 3'-UUCCAACCUUUAAUAUGCAAAUAUGAA-5' | (SEQ ID NO: 592) |
| MCL1-m2651 Target: | 5'-AAGGTTGGAAATTATACGTTTATACTT-3' | (SEQ ID NO: 907) |
| | 5'-AUUAGUUUGCUCCAAGUAUGACUGU-3' | (SEQ ID NO: 1223) |
| | 3'-AAUAAUCAAACGAGGUUCAUACUGACA-5' | (SEQ ID NO: 593) |
| MCL1-m2678 Target: | 5'-TTATTAGTTTGCTCCAAGTATGACTGT-3' | (SEQ ID NO: 908) |
| | 5'-CACUUAAGUUUAGAGAAACACUGGG-3' | (SEQ ID NO: 1224) |
| | 3'-AAGUGAAUUCAAAUCUCUUUGUGACCC-5' | (SEQ ID NO: 594) |
| MCL1-m2706 Target: | 5'-TTCACTTAAGTTTAGAGAAACACTGGG-3' | (SEQ ID NO: 909) |
| | 5'-ACUGGUAACUGAAGGUAUUUAAGCU-3' | (SEQ ID NO: 1225) |
| | 3'-GGUGACCAUUGACUUCCAUAAAUUCGA-5' | (SEQ ID NO: 595) |
| MCL1-m2758 Target: | 5'-CCACTGGTAACTGAAGGTATTTAAGCT-3' | (SEQ ID NO: 910) |
| | 5'-GCCUCAGAAUGUGACCUUUAGUCAG-3' | (SEQ ID NO: 1226) |
| | 3'-GUCGGAGUCUUACACUGGAAAUCAGUC-5' | (SEQ ID NO: 596) |
| MCL1-m2803 Target: | 5'-CAGCCTCAGAATGTGACCTTTAGTCAG-3' | (SEQ ID NO: 911) |
| | 5'-UAGGCAGGAAUCAAAUGACUAAGAA-3' | (SEQ ID NO: 1227) |
| | 3'-UUAUCCGUCCUUAGUUUACUGAUUCUU-5' | (SEQ ID NO: 597) |
| MCL1-m2843 Target: | 5'-AATAGGCAGGAATCAAATGACTAAGAA-3' | (SEQ ID NO: 912) |
| | 5'-AGGCAGGAAUCAAAUGACUAAGAAU-3' | (SEQ ID NO: 1228) |
| | 3'-UAUCCGUCCUUAGUUUACUGAUUCUUA-5' | (SEQ ID NO: 598) |
| MCL1-m2844 Target: | 5'-ATAGGCAGGAATCAAATGACTAAGAAT-3' | (SEQ ID NO: 913) |
| | 5'-GGCAGGAAUCAAAUGACUAAGAAUG-3' | (SEQ ID NO: 1229) |
| | 3'-AUCCGUCCUUAGUUUACUGAUUCUUAC-5' | (SEQ ID NO: 599) |
| MCL1-m2845 Target: | 5'-TAGGCAGGAATCAAATGACTAAGAATG-3' | (SEQ ID NO: 914) |
| | 5'-GCAGGAAUCAAAUGACUAAGAAUGU-3' | (SEQ ID NO: 1230) |
| | 3'-UCCGUCCUUAGUUUACUGAUUCUUACA-5' | (SEQ ID NO: 600) |
| MCL1-m2846 Target: | 5'-AGGCAGGAATCAAATGACTAAGAATGT-3' | (SEQ ID NO: 915) |
| | 5'-CAGGAAUCAAAUGACUAAGAAUGUA-3' | (SEQ ID NO: 1231) |
| | 3'-CCGUCCUUAGUUUACUGAUUCUUACAU-5' | (SEQ ID NO: 601) |
| MCL1-m2847 Target: | 5'-GGCAGGAATCAAATGACTAAGAATGTA-3' | (SEQ ID NO: 916) |
| | 5'-AGGAAUCAAAUGACUAAGAAUGUAA-3' | (SEQ ID NO: 1232) |
| | 3'-CGUCCUUAGUUUACUGAUUCUUACAUU-5' | (SEQ ID NO: 602) |
| MCL1-m2848 Target: | 5'-GCAGGAATCAAATGACTAAGAATGTAA-3' | (SEQ ID NO: 917) |
| | 5'-GGAAUCAAAUGACUAAGAAUGUAAU-3' | (SEQ ID NO: 1233) |
| | 3'-GUCCUUAGUUUACUGAUUCUUACAUUA-5' | (SEQ ID NO: 603) |
| MCL1-m2849 Target: | 5'-CAGGAATCAAATGACTAAGAATGTAAT-3' | (SEQ ID NO: 918) |
| | 5'-GAAUCAAAUGACUAAGAAUGUAAUA-3' | (SEQ ID NO: 1234) |
| | 3'-UCCUUAGUUUACUGAUUCUUACAUUAU-5' | (SEQ ID NO: 604) |
| MCL1-m2850 Target: | 5'-AGGAATCAAATGACTAAGAATGTAATA-3' | (SEQ ID NO: 919) |
| | 5'-GACUAAGAAUGUAAUAGGGAAGAAG-3' | (SEQ ID NO: 1235) |
| | 3'-UACUGAUUCUUACAUUAUCCCUUCUUC-5' | (SEQ ID NO: 605) |
| MCL1-m2859 Target: | 5'-ATGACTAAGAATGTAATAGGGAAGAAG-3' | (SEQ ID NO: 920) |

TABLE 5-continued

Selected Mouse Anti-MCL1 DsiRNAs, Unmodified Duplexes (Asymmetrics)

| | | |
|---|---|---|
| MCL1-m2894 Target: | 5'-GCCAGCUUGGGAGUGAUUUGUACCU-3'<br>3'-GACGGUCGAACCCUCACUAAACAUGGA-5'<br>5'-CTGCCAGCTTGGGAGTGATTTGTACCT-3' | (SEQ ID NO: 1236)<br>(SEQ ID NO: 606)<br>(SEQ ID NO: 921) |
| MCL1-m2929 Target: | 5'-CCUUGAUCAUAGUUUGCUUAUUUAU-3'<br>3'-UAGGAACUAGUAUCAAACGAAUAAAUA-5'<br>5'-ATCCTTGATCATAGTTTGCTTATTTAT-3' | (SEQ ID NO: 1237)<br>(SEQ ID NO: 607)<br>(SEQ ID NO: 922) |
| MCL1-m2975 Target: | 5'-AGCACUUUAUGUAGUUGAAUAAACC-3'<br>3'-UCUCGUGAAAUACAUCAACUUAUUUGG-5'<br>5'-AGAGCACTTTATGTAGTTGAATAAACC-3' | (SEQ ID NO: 1238)<br>(SEQ ID NO: 608)<br>(SEQ ID NO: 923) |
| MCL1-m2976 Target: | 5'-GCACUUUAUGUAGUUGAAUAAACCC-3'<br>3'-CUCGUGAAAUACAUCAACUUAUUUGGG-5'<br>5'-GAGCACTTTATGTAGTTGAATAAACCC-3' | (SEQ ID NO: 1239)<br>(SEQ ID NO: 609)<br>(SEQ ID NO: 924) |
| MCL1-m3055 Target: | 5'-UGUUUACUAGGAGCCUGACUUCCCA-3'<br>3'-AAACAAAUGAUCCUCGGACUGAAGGGU-5'<br>5'-TTTGTTTACTAGGAGCCTGACTTCCCA-3' | (SEQ ID NO: 1240)<br>(SEQ ID NO: 610)<br>(SEQ ID NO: 925) |
| MCL1-m3068 Target: | 5'-CCUGACUUCCCAGCUCACAAAGGGU-3'<br>3'-UCGGACUGAAGGGUCGAGUGUUUCCCA-5'<br>5'-AGCCTGACTTCCCAGCTCACAAAGGGT-3' | (SEQ ID NO: 1241)<br>(SEQ ID NO: 611)<br>(SEQ ID NO: 926) |
| MCL1-m3069 Target: | 5'-CUGACUUCCCAGCUCACAAAGGGUG-3'<br>3'-CGGACUGAAGGGUCGAGUGUUUCCCAC-5'<br>5'-GCCTGACTTCCCAGCTCACAAAGGGTG-3' | (SEQ ID NO: 1242)<br>(SEQ ID NO: 612)<br>(SEQ ID NO: 927) |
| MCL1-m3070 Target: | 5'-UGACUUCCCAGCUCACAAAGGGUGA-3'<br>3'-GGACUGAAGGGUCGAGUGUUUCCCACU-5'<br>5'-CCTGACTTCCCAGCTCACAAAGGGTGA-3' | (SEQ ID NO: 1243)<br>(SEQ ID NO: 613)<br>(SEQ ID NO: 928) |
| MCL1-m3077 Target: | 5'-CCAGCUCACAAAGGGUGAAAUGAAA-3'<br>3'-AGGGUCGAGUGUUUCCCACUUUACUUU-5'<br>5'-TCCCAGCTCACAAAGGGTGAAATGAAA-3' | (SEQ ID NO: 1244)<br>(SEQ ID NO: 614)<br>(SEQ ID NO: 929) |
| MCL1-m3081 Target: | 5'-CUCACAAAGGGUGAAAUGAAAGCUG-3'<br>3'-UCGAGUGUUUCCCACUUUACUUUCGAC-5'<br>5'-AGCTCACAAAGGGTGAAATGAAAGCTG-3' | (SEQ ID NO: 1245)<br>(SEQ ID NO: 615)<br>(SEQ ID NO: 930) |
| MCL1-m3104 Target: | 5'-UGAAGUACAGACAGGAUCUUAGUAG-3'<br>3'-CGACUUCAUGUCUGUCCUAGAAUCAUC-5'<br>5'-GCTGAAGTACAGACAGGATCTTAGTAG-3' | (SEQ ID NO: 1246)<br>(SEQ ID NO: 616)<br>(SEQ ID NO: 931) |
| MCL1-m3107 Target: | 5'-AGUACAGACAGGAUCUUAGUAGGUA-3'<br>3'-CUUCAUGUCUGUCCUAGAAUCAUCCAU-5'<br>5'-GAAGTACAGACAGGATCTTAGTAGGTA-3' | (SEQ ID NO: 1247)<br>(SEQ ID NO: 617)<br>(SEQ ID NO: 932) |
| MCL1-m3145 Target: | 5'-GCCAUGAAGACUUGGAGAGCGCAGU-3'<br>3'-CCCGGUACUUCUGAACCUCUCGCGUCA-5'<br>5'-GGGCCATGAAGACTTGGAGAGCGCAGT-3' | (SEQ ID NO: 1248)<br>(SEQ ID NO: 618)<br>(SEQ ID NO: 933) |
| MCL1-m3189 Target: | 5'-UUGGAGGGAAGAAGCAUGUGGUCUG-3'<br>3'-GAAACCUCCCUUCUUCGUACACCAGAC-5'<br>5'-CTTTGGAGGGAAGAAGCATGTGGTCTG-3' | (SEQ ID NO: 1249)<br>(SEQ ID NO: 619)<br>(SEQ ID NO: 934) |
| MCL1-m3214 Target: | 5'-AGUGCUGACUAGAUGAAUAGUUGAG-3'<br>3'-ACUCACGACUGAUCUACUUAUCAACUC-5'<br>5'-TGAGTGCTGACTAGATGAATAGTTGAG-3' | (SEQ ID NO: 1250)<br>(SEQ ID NO: 620)<br>(SEQ ID NO: 935) |
| MCL1-m3219 Target: | 5'-UGACUAGAUGAAUAGUUGAGGCACA-3'<br>3'-CGACUGAUCUACUUAUCAACUCCGUGU-5'<br>5'-GCTGACTAGATGAATAGTTGAGGCACA-3' | (SEQ ID NO: 1251)<br>(SEQ ID NO: 621)<br>(SEQ ID NO: 936) |
| MCL1-m3237 Target: | 5'-AGGCACAUCCUUCAGAGAAGAGGGA-3'<br>3'-ACUCCGUGUAGGAAGUCUCUUCUCCCU-5'<br>5'-TGAGGCACATCCTTCAGAGAAGAGGGA-3' | (SEQ ID NO: 1252)<br>(SEQ ID NO: 622)<br>(SEQ ID NO: 937) |
| MCL1-m3238 Target: | 5'-GGCACAUCCUUCAGAGAAGAGGGAG-3'<br>3'-CUCCGUGUAGGAAGUCUCUUCUCCCUC-5'<br>5'-GAGGCACATCCTTCAGAGAAGAGGGAG-3' | (SEQ ID NO: 1253)<br>(SEQ ID NO: 623)<br>(SEQ ID NO: 938) |
| MCL1-m3265 Target: | 5'-GCUGCUUGGAAAGAUGGCUCUCAGC-3'<br>3'-CCCGACGAACCUUUCUACCGAGAGUCG-5'<br>5'-GGGCTGCTTGGAAAGATGGCTCTCAGC-3' | (SEQ ID NO: 1254)<br>(SEQ ID NO: 624)<br>(SEQ ID NO: 939) |

TABLE 5-continued

| Selected Mouse Anti-MCL1 DsiRNAs, Unmodified Duplexes (Asymmetrics) | | |
|---|---|---|
| | 5'-UCUGUUUGUCUUACACGUCUCUCAG-3' | (SEQ ID NO: 1255) |
| | 3'-UUAGACAAACAGAAUGUGCAGAGAGUC-5' | (SEQ ID NO: 625) |
| MCL1-m3294 Target: | 5'-AATCTGTTTGTCTTACACGTCTCTCAG-3' | (SEQ ID NO: 940) |
| | 5'-AGCAUCUUCCAUGUACAUUCUAUCU-3' | (SEQ ID NO: 1256) |
| | 3'-GUUCGUAGAAGGUACAUGUAAGAUAGA-5' | (SEQ ID NO: 626) |
| MCL1-m3340 Target: | 5'-CAAGCATCTTCCATGTACATTCTATCT-3' | (SEQ ID NO: 941) |
| | 5'-GCACCUAACACUUUAACAGCUGUUC-3' | (SEQ ID NO: 1257) |
| | 3'-CUCGUGGAUUGUGAAAUUGUCGACAAG-5' | (SEQ ID NO: 627) |
| MCL1-m3390 Target: | 5'-GAGCACCTAACACTTTAACAGCTGTTC-3' | (SEQ ID NO: 942) |
| | 5'-AGCUGUUCCCGAAAGGGUUAGGACC-3' | (SEQ ID NO: 1258) |
| | 3'-UGUCGACAAGGGCUUUCCCAAUCCUGG-5' | (SEQ ID NO: 628) |
| MCL1-m3407 Target: | 5'-ACAGCTGTTCCCGAAAGGGTTAGGACC-3' | (SEQ ID NO: 943) |
| | 5'-CGAAAGGGUUAGGACCAACUGCAAG-3' | (SEQ ID NO: 1259) |
| | 3'-GGGCUUUCCCAAUCCUGGUUGACGUUC-5' | (SEQ ID NO: 629) |
| MCL1-m3416 Target: | 5'-CCCGAAAGGGTTAGGACCAACTGCAAG-3' | (SEQ ID NO: 944) |
| | 5'-CCAACUGCAAGUUAAUGUGGGUUGU-3' | (SEQ ID NO: 1260) |
| | 3'-CUGGUUGACGUUCAAUUACACCCAACA-5' | (SEQ ID NO: 630) |
| MCL1-m3430 Target: | 5'-GACCAACTGCAAGTTAATGTGGGTTGT-3' | (SEQ ID NO: 945) |
| | 5'-CUGGAAGAGUCACUGUCUGAAUGAA-3' | (SEQ ID NO: 2589) |
| | 3'-GGGACCUUCUCAGUGACAGACUUACUU-5' | (SEQ ID NO: 2397) |
| MCL1-m1355 Target: | 5'-CCCTGGAAGAGTCACTGTCTGAATGAA-3' | (SEQ ID NO: 2493) |

Projected 21 nucleotide target sequences for each DsiRNA of Tables 2-5 above and of Tables 7-10 below are presented in Table 6.

TABLE 6

| DsiRNA Target Sequences (21mers) In MCL1 mRNA | | |
|---|---|---|
| MCL1-72 21 nt Target: | 5'-UCGCCACUUCUCACUUCCGCU-3' | (SEQ ID NO: 1261) |
| MCL1-75 21 nt Target: | 5'-CCACUUCUCACUUCCGCUUCC-3' | (SEQ ID NO: 1262) |
| MCL1-141 21 nt Target: | 5'-GCGGCGGCGACUGGCAAUGUU-3' | (SEQ ID NO: 1263) |
| MCL1-175 21 nt Target: | 5'-AACGCGGUAAUCGGACUCAAC-3' | (SEQ ID NO: 1264) |
| MCL1-250 21 nt Target: | 5'-GGAGGGCGACUUUUGGCUACG-3' | (SEQ ID NO: 1265) |
| MCL1-434 21 nt Target: | 5'-CCGCGAGGCUGCUUUUCUUCG-3' | (SEQ ID NO: 1266) |
| MCL1-604 21 nt Target: | 5'-UCUGGUAAUAACACCAGUACG-3' | (SEQ ID NO: 1267) |
| MCL1-661 21 nt Target: | 5'-GAGGAGGAGGACGAGUUGUAC-3' | (SEQ ID NO: 1268) |
| MCL1-680 21 nt Target: | 5'-ACCGGCAGUCGCUGGAGAUUA-3' | (SEQ ID NO: 1269) |
| MCL1-733 21 nt Target: | 5'-GCCAAGGACACAAAGCCAAUG-3' | (SEQ ID NO: 1270) |
| MCL1-774 21 nt Target: | 5'-CAGGAAGGCGCUGGAGACCUU-3' | (SEQ ID NO: 1271) |
| MCL1-809 21 nt Target: | 5'-AUGGCGUGCAGCGCAACCACG-3' | (SEQ ID NO: 1272) |
| MCL1-810 21 nt Target: | 5'-UGGCGUGCAGCGCAACCACGA-3' | (SEQ ID NO: 1273) |
| MCL1-811 21 nt Target: | 5'-GGCGUGCAGCGCAACCACGAG-3' | (SEQ ID NO: 1274) |
| MCL1-812 21 nt Target: | 5'-GCGUGCAGCGCAACCACGAGA-3' | (SEQ ID NO: 1275) |
| MCL1-813 21 nt Target: | 5'-CGUGCAGCGCAACCACGAGAC-3' | (SEQ ID NO: 1276) |
| MCL1-814 21 nt Target: | 5'-GUGCAGCGCAACCACGAGACG-3' | (SEQ ID NO: 1277) |
| MCL1-815 21 nt Target: | 5'-UGCAGCGCAACCACGAGACGG-3' | (SEQ ID NO: 1278) |
| MCL1-816 21 nt Target: | 5'-GCAGCGCAACCACGAGACGGC-3' | (SEQ ID NO: 1279) |
| MCL1-817 21 nt Target: | 5'-CAGCGCAACCACGAGACGGCC-3' | (SEQ ID NO: 1280) |

TABLE 6-continued

DsiRNA Target Sequences (21mers) In MCL1 mRNA

| | | |
|---|---|---|
| MCL1-818 21 nt Target: | 5'-AGCGCAACCACGAGACGGCCU-3' | (SEQ ID NO: 1281) |
| MCL1-819 21 nt Target: | 5'-GCGCAACCACGAGACGGCCUU-3' | (SEQ ID NO: 1282) |
| MCL1-820 21 nt Target: | 5'-CGCAACCACGAGACGGCCUUC-3' | (SEQ ID NO: 1283) |
| MCL1-821 21 nt Target: | 5'-GCAACCACGAGACGGCCUUCC-3' | (SEQ ID NO: 1284) |
| MCL1-822 21 nt Target: | 5'-CAACCACGAGACGGCCUUCCA-3' | (SEQ ID NO: 1285) |
| MCL1-838 21 nt Target: | 5'-UUCCAAGGCAUGCUUCGGAAA-3' | (SEQ ID NO: 1286) |
| MCL1-839 21 nt Target: | 5'-UCCAAGGCAUGCUUCGGAAAC-3' | (SEQ ID NO: 1287) |
| MCL1-871 21 nt Target: | 5'-AACGAAGACGAUGUGAAAUCG-3' | (SEQ ID NO: 1288) |
| MCL1-877 21 nt Target: | 5'-GACGAUGUGAAAUCGUUGUCU-3' | (SEQ ID NO: 1289) |
| MCL1-939 21 nt Target: | 5'-GGGCAGGAUUGUGACUCUCAU-3' | (SEQ ID NO: 1290) |
| MCL1-947 21 nt Target: | 5'-UUGUGACUCUCAUUUCUUUUG-3' | (SEQ ID NO: 1291) |
| MCL1-970 21 nt Target: | 5'-GCCUUUGUGGCUAAACACUUG-3' | (SEQ ID NO: 1292) |
| MCL1-975 21 nt Target: | 5'-UGUGGCUAAACACUUGAAGAC-3' | (SEQ ID NO: 1293) |
| MCL1-976 21 nt Target: | 5'-GUGGCUAAACACUUGAAGACC-3' | (SEQ ID NO: 1294) |
| MCL1-977 21 nt Target: | 5'-UGGCUAAACACUUGAAGACCA-3' | (SEQ ID NO: 1295) |
| MCL1-978 21 nt Target: | 5'-GGCUAAACACUUGAAGACCAU-3' | (SEQ ID NO: 1296) |
| MCL1-984 21 nt Target: | 5'-ACACUUGAAGACCAUAAACCA-3' | (SEQ ID NO: 1297) |
| MCL1-985 21 nt Target: | 5'-CACUUGAAGACCAUAAACCAA-3' | (SEQ ID NO: 1298) |
| MCL1-990 21 nt Target: | 5'-GAAGACCAUAAACCAAGAAAG-3' | (SEQ ID NO: 1299) |
| MCL1-1012 21 nt Target: | 5'-UGCAUCGAACCAUUAGCAGAA-3' | (SEQ ID NO: 1300) |
| MCL1-1013 21 nt Target: | 5'-GCAUCGAACCAUUAGCAGAAA-3' | (SEQ ID NO: 1301) |
| MCL1-1018 21 nt Target: | 5'-GAACCAUUAGCAGAAAGUAUC-3' | (SEQ ID NO: 1302) |
| MCL1-1062 21 nt Target: | 5'-ACGGGACUGGCUAGUUAAACA-3' | (SEQ ID NO: 1303) |
| MCL1-1063 21 nt Target: | 5'-CGGGACUGGCUAGUUAAACAA-3' | (SEQ ID NO: 1304) |
| MCL1-1070 21 nt Target: | 5'-GGCUAGUUAAACAAAGAGGCU-3' | (SEQ ID NO: 1305) |
| MCL1-1076 21 nt Target: | 5'-UUAAACAAAGAGGCUGGGAUG-3' | (SEQ ID NO: 1306) |
| MCL1-1077 21 nt Target: | 5'-UAAACAAAGAGGCUGGGAUGG-3' | (SEQ ID NO: 1307) |
| MCL1-1078 21 nt Target: | 5'-AAACAAAGAGGCUGGGAUGGG-3' | (SEQ ID NO: 1308) |
| MCL1-1079 21 nt Target: | 5'-AACAAAGAGGCUGGGAUGGGU-3' | (SEQ ID NO: 1309) |
| MCL1-1080 21 nt Target: | 5'-ACAAAGAGGCUGGGAUGGGUU-3' | (SEQ ID NO: 1310) |
| MCL1-1081 21 nt Target: | 5'-CAAAGAGGCUGGGAUGGGUUU-3' | (SEQ ID NO: 1311) |
| MCL1-1082 21 nt Target: | 5'-AAAGAGGCUGGGAUGGGUUUG-3' | (SEQ ID NO: 1312) |
| MCL1-1083 21 nt Target: | 5'-AAGAGGCUGGGAUGGGUUUGU-3' | (SEQ ID NO: 1313) |
| MCL1-1084 21 nt Target: | 5'-AGAGGCUGGGAUGGGUUUGUG-3' | (SEQ ID NO: 1314) |
| MCL1-1085 21 nt Target: | 5'-GAGGCUGGGAUGGGUUUGUGG-3' | (SEQ ID NO: 1315) |
| MCL1-1086 21 nt Target: | 5'-AGGCUGGGAUGGGUUUGUGGA-3' | (SEQ ID NO: 1316) |
| MCL1-1087 21 nt Target: | 5'-GGCUGGGAUGGGUUUGUGGAG-3' | (SEQ ID NO: 1317) |
| MCL1-1088 21 nt Target: | 5'-GCUGGGAUGGGUUUGUGGAGU-3' | (SEQ ID NO: 1318) |
| MCL1-1089 21 nt Target: | 5'-CUGGGAUGGGUUUGUGGAGUU-3' | (SEQ ID NO: 1319) |

TABLE 6-continued

DsiRNA Target Sequences (21mers) In MCL1 mRNA

| | | |
|---|---|---|
| MCL1-1090 21 nt Target: | 5'-UGGGAUGGGUUUGUGGAGUUC-3' | (SEQ ID NO: 1320) |
| MCL1-1091 21 nt Target: | 5'-GGGAUGGGUUUGUGGAGUUCU-3' | (SEQ ID NO: 1321) |
| MCL1-1092 21 nt Target: | 5'-GGAUGGGUUUGUGGAGUUCUU-3' | (SEQ ID NO: 1322) |
| MCL1-1093 21 nt Target: | 5'-GAUGGGUUUGUGGAGUUCUUC-3' | (SEQ ID NO: 1323) |
| MCL1-1094 21 nt Target: | 5'-AUGGGUUUGUGGAGUUCUUCC-3' | (SEQ ID NO: 1324) |
| MCL1-1095 21 nt Target: | 5'-UGGGUUUGUGGAGUUCUUCCA-3' | (SEQ ID NO: 1325) |
| MCL1-1104 21 nt Target: | 5'-GGAGUUCUUCCAUGUAGAGGA-3' | (SEQ ID NO: 1326) |
| MCL1-1111 21 nt Target: | 5'-UUCCAUGUAGAGGACCUAGAA-3' | (SEQ ID NO: 1327) |
| MCL1-1120 21 nt Target: | 5'-GAGGACCUAGAAGGUGGCAUC-3' | (SEQ ID NO: 1328) |
| MCL1-1163 21 nt Target: | 5'-CAGGUGUUGCUGGAGUAGGAG-3' | (SEQ ID NO: 1329) |
| MCL1-1182 21 nt Target: | 5'-AGCUGGUUUGGCAUAUCUAAU-3' | (SEQ ID NO: 1330) |
| MCL1-1188 21 nt Target: | 5'-UUUGGCAUAUCUAAUAAGAUA-3' | (SEQ ID NO: 1331) |
| MCL1-1189 21 nt Target: | 5'-UUGGCAUAUCUAAUAAGAUAG-3' | (SEQ ID NO: 1332) |
| MCL1-1190 21 nt Target: | 5'-UGGCAUAUCUAAUAAGAUAGC-3' | (SEQ ID NO: 1333) |
| MCL1-1191 21 nt Target: | 5'-GGCAUAUCUAAUAAGAUAGCC-3' | (SEQ ID NO: 1334) |
| MCL1-1192 21 nt Target: | 5'-GCAUAUCUAAUAAGAUAGCCU-3' | (SEQ ID NO: 1335) |
| MCL1-1193 21 nt Target: | 5'-CAUAUCUAAUAAGAUAGCCUU-3' | (SEQ ID NO: 1336) |
| MCL1-1207 21 nt Target: | 5'-UAGCCUUACUGUAAGUGCAAU-3' | (SEQ ID NO: 1337) |
| MCL1-1276 21 nt Target: | 5'-UUGGACUCCAAGCUGUAACUU-3' | (SEQ ID NO: 1338) |
| MCL1-1293 21 nt Target: | 5'-ACUUCCUAGAGUUGCACCCUA-3' | (SEQ ID NO: 1339) |
| MCL1-1329 21 nt Target: | 5'-AAGCAAGUGGCAAGAGGAUUA-3' | (SEQ ID NO: 1340) |
| MCL1-1334 21 nt Target: | 5'-AGUGGCAAGAGGAUUAUGGCU-3' | (SEQ ID NO: 1341) |
| MCL1-1335 21 nt Target: | 5'-GUGGCAAGAGGAUUAUGGCUA-3' | (SEQ ID NO: 1342) |
| MCL1-1340 21 nt Target: | 5'-AAGAGGAUUAUGGCUAACAAG-3' | (SEQ ID NO: 1343) |
| MCL1-1348 21 nt Target: | 5'-UAUGGCUAACAAGAAUAAAUA-3' | (SEQ ID NO: 1344) |
| MCL1-1349 21 nt Target: | 5'-AUGGCUAACAAGAAUAAAUAC-3' | (SEQ ID NO: 1345) |
| MCL1-1350 21 nt Target: | 5'-UGGCUAACAAGAAUAAAUACA-3' | (SEQ ID NO: 1346) |
| MCL1-1351 21 nt Target: | 5'-GGCUAACAAGAAUAAAUACAU-3' | (SEQ ID NO: 1347) |
| MCL1-1352 21 nt Target: | 5'-GCUAACAAGAAUAAAUACAUG-3' | (SEQ ID NO: 1348) |
| MCL1-1353 21 nt Target: | 5'-CUAACAAGAAUAAAUACAUGG-3' | (SEQ ID NO: 1349) |
| MCL1-1354 21 nt Target: | 5'-UAACAAGAAUAAAUACAUGGG-3' | (SEQ ID NO: 1350) |
| MCL1-1355 21 nt Target: | 5'-AACAAGAAUAAAUACAUGGGA-3' | (SEQ ID NO: 1351) |
| MCL1-1356 21 nt Target: | 5'-ACAAGAAUAAAUACAUGGGAA-3' | (SEQ ID NO: 1352) |
| MCL1-1357 21 nt Target: | 5'-CAAGAAUAAAUACAUGGGAAG-3' | (SEQ ID NO: 1353) |
| MCL1-1385 21 nt Target: | 5'-CCCAUUGAUUGAAGAGUCACU-3' | (SEQ ID NO: 1354) |
| MCL1-1402 21 nt Target: | 5'-CACUGUCUGAAAGAAGCAAAG-3' | (SEQ ID NO: 1355) |
| MCL1-1438 21 nt Target: | 5'-AAACAAACUUUGUUUGGGAAG-3' | (SEQ ID NO: 1356) |
| MCL1-1466 21 nt Target: | 5'-GGAGGACUUUUAGAUUUAGUG-3' | (SEQ ID NO: 1357) |
| MCL1-1486 21 nt Target: | 5'-GAAGAUGGUAGGGUGGAAAGA-3' | (SEQ ID NO: 1358) |

TABLE 6-continued

DsiRNA Target Sequences (21mers) In MCL1 mRNA

| | | |
|---|---|---|
| MCL1-1514 21 nt Target: | 5'-UCCUUGUUGAGAACAGGAAAG-3' | (SEQ ID NO: 1359) |
| MCL1-1542 21 nt Target: | 5'-UAGCCAGGCAAGUCAUAGAAU-3' | (SEQ ID NO: 1360) |
| MCL1-1545 21 nt Target: | 5'-CCAGGCAAGUCAUAGAAUUGA-3' | (SEQ ID NO: 1361) |
| MCL1-1546 21 nt Target: | 5'-CAGGCAAGUCAUAGAAUUGAU-3' | (SEQ ID NO: 1362) |
| MCL1-1567 21 nt Target: | 5'-UACCCGCCGAAUUCAUUAAUU-3' | (SEQ ID NO: 1363) |
| MCL1-1572 21 nt Target: | 5'-GCCGAAUUCAUUAAUUUACUG-3' | (SEQ ID NO: 1364) |
| MCL1-1593 21 nt Target: | 5'-UAGUGUUAAGAGAAGCACUAA-3' | (SEQ ID NO: 1365) |
| MCL1-1604 21 nt Target: | 5'-GAAGCACUAAGAAUGCCAGUG-3' | (SEQ ID NO: 1366) |
| MCL1-1640 21 nt Target: | 5'-ACAAGUAAUAGAACUAUGACU-3' | (SEQ ID NO: 1367) |
| MCL1-1642 21 nt Target: | 5'-AAGUAAUAGAACUAUGACUGU-3' | (SEQ ID NO: 1368) |
| MCL1-1665 21 nt Target: | 5'-GCCUCAGUACUGUACAAGGGA-3' | (SEQ ID NO: 1369) |
| MCL1-1711 21 nt Target: | 5'-UCCCAGUAUACUUCUUAGAAA-3' | (SEQ ID NO: 1370) |
| MCL1-1754 21 nt Target: | 5'-UACCUGUUAUACUUUGGCUUG-3' | (SEQ ID NO: 1371) |
| MCL1-1798 21 nt Target: | 5'-AGCCUAGUUUAUCACCAAUAA-3' | (SEQ ID NO: 1372) |
| MCL1-1808 21 nt Target: | 5'-AUCACCAAUAAUACUUGACGG-3' | (SEQ ID NO: 1373) |
| MCL1-1809 21 nt Target: | 5'-UCACCAAUAAUACUUGACGGA-3' | (SEQ ID NO: 1374) |
| MCL1-1810 21 nt Target: | 5'-CACCAAUAAUACUUGACGGAA-3' | (SEQ ID NO: 1375) |
| MCL1-1829 21 nt Target: | 5'-AAGGCUCAGUAAUUAGUUAUG-3' | (SEQ ID NO: 1376) |
| MCL1-1833 21 nt Target: | 5'-CUCAGUAAUUAGUUAUGAAUA-3' | (SEQ ID NO: 1377) |
| MCL1-1866 21 nt Target: | 5'-AUUCUUAAGACAGCUUGUAAA-3' | (SEQ ID NO: 1378) |
| MCL1-1893 21 nt Target: | 5'-UGUAAAAAUUGUAUAUAUUUU-3' | (SEQ ID NO: 1379) |
| MCL1-1912 21 nt Target: | 5'-UUUACAGAAAGUCUAUUUCUU-3' | (SEQ ID NO: 1380) |
| MCL1-1913 21 nt Target: | 5'-UUACAGAAAGUCUAUUUCUUU-3' | (SEQ ID NO: 1381) |
| MCL1-1914 21 nt Target: | 5'-UACAGAAAGUCUAUUUCUUUG-3' | (SEQ ID NO: 1382) |
| MCL1-1915 21 nt Target: | 5'-ACAGAAAGUCUAUUUCUUUGA-3' | (SEQ ID NO: 1383) |
| MCL1-1916 21 nt Target: | 5'-CAGAAAGUCUAUUUCUUUGAA-3' | (SEQ ID NO: 1384) |
| MCL1-1936 21 nt Target: | 5'-AACGAAGGAAGUAUCGAAUUU-3' | (SEQ ID NO: 1385) |
| MCL1-1948 21 nt Target: | 5'-AUCGAAUUUACAUUAGUUUUU-3' | (SEQ ID NO: 1386) |
| MCL1-1982 21 nt Target: | 5'-GAACUUUGCAACUUCCGUAAU-3' | (SEQ ID NO: 1387) |
| MCL1-2057 21 nt Target: | 5'-AGAGUGUAUACAGAACGAAUU-3' | (SEQ ID NO: 1388) |
| MCL1-2107 21 nt Target: | 5'-GUGGAACAAAUCUGAUAACUA-3' | (SEQ ID NO: 1389) |
| MCL1-2137 21 nt Target: | 5'-AAAUUUCUUAUCUGAUUUUG-3' | (SEQ ID NO: 1390) |
| MCL1-2174 21 nt Target: | 5'-UAGGUUUUUCUUUGAAAACCU-3' | (SEQ ID NO: 1391) |
| MCL1-2193 21 nt Target: | 5'-CUGGGAUUGAGAGGUUGAUGA-3' | (SEQ ID NO: 1392) |
| MCL1-2200 21 nt Target: | 5'-UGAGAGGUUGAUGAAUGGAAA-3' | (SEQ ID NO: 1393) |
| MCL1-2204 21 nt Target: | 5'-AGGUUGAUGAAUGGAAAUUCU-3' | (SEQ ID NO: 1394) |
| MCL1-2235 21 nt Target: | 5'-UAUAUGCAAGUUUUCAAUAAU-3' | (SEQ ID NO: 1395) |
| MCL1-2275 21 nt Target: | 5'-AAGGUUACUGAUGACUUACAA-3' | (SEQ ID NO: 1396) |
| MCL1-2309 21 nt Target: | 5'-AUUGGGCAAUACUCAUUUGAG-3' | (SEQ ID NO: 1397) |

TABLE 6-continued

DsiRNA Target Sequences (21mers) In MCL1 mRNA

| | | |
|---|---|---|
| MCL1-2334 21 nt Target: | 5'-UUCCAUUUGACCUAAUUUAAC-3' | (SEQ ID NO: 1398) |
| MCL1-2389 21 nt Target: | 5'-UUAAAGCUUUUACUAAAAGAU-3' | (SEQ ID NO: 1399) |
| MCL1-2459 21 nt Target: | 5'-CAGGUGGAUGGAGAGACAUUU-3' | (SEQ ID NO: 1400) |
| MCL1-2491 21 nt Target: | 5'-UGCUUAAUAAAUUAUAAAAUG-3' | (SEQ ID NO: 1401) |
| MCL1-2536 21 nt Target: | 5'-UAACCAUGGUGCUAUUAUUAG-3' | (SEQ ID NO: 1402) |
| MCL1-2581 21 nt Target: | 5'-UAAGCCUAGUAUGUCAAUAAA-3' | (SEQ ID NO: 1403) |
| MCL1-2611 21 nt Target: | 5'-UACUGUUUUGUUUCUAUUAAU-3' | (SEQ ID NO: 1404) |
| MCL1-2622 21 nt Target: | 5'-UUCUAUUAAUGAUUCCCAAAC-3' | (SEQ ID NO: 1405) |
| MCL1-2643 21 nt Target: | 5'-CUUGUUGCAAGUUUUUGCAUU-3' | (SEQ ID NO: 1406) |
| MCL1-2671 21 nt Target: | 5'-UUGGAUUUCAGUCUUGAUGUU-3' | (SEQ ID NO: 1407) |
| MCL1-2725 21 nt Target: | 5'-CUUCCUUGAAAUUGCUGAUUG-3' | (SEQ ID NO: 1408) |
| MCL1-2750 21 nt Target: | 5'-GCUCCCUCUACAGAUAUUUAU-3' | (SEQ ID NO: 1409) |
| MCL1-2874 21 nt Target: | 5'-CCACCAAGAGUCCACAGACCU-3' | (SEQ ID NO: 1410) |
| MCL1-2875 21 nt Target: | 5'-CACCAAGAGUCCACAGACCUU-3' | (SEQ ID NO: 1411) |
| MCL1-2881 21 nt Target: | 5'-GAGUCCACAGACCUUUCAUCU-3' | (SEQ ID NO: 1412) |
| MCL1-2882 21 nt Target: | 5'-AGUCCACAGACCUUUCAUCUU-3' | (SEQ ID NO: 1413) |
| MCL1-2883 21 nt Target: | 5'-GUCCACAGACCUUUCAUCUUU-3' | (SEQ ID NO: 1414) |
| MCL1-2884 21 nt Target: | 5'-UCCACAGACCUUUCAUCUUUC-3' | (SEQ ID NO: 1415) |
| MCL1-2887 21 nt Target: | 5'-ACAGACCUUUCAUCUUUCACG-3' | (SEQ ID NO: 1416) |
| MCL1-2890 21 nt Target: | 5'-GACCUUUCAUCUUUCACGAAC-3' | (SEQ ID NO: 1417) |
| MCL1-2945 21 nt Target: | 5'-CUGUGACACUAACAGUCAUUG-3' | (SEQ ID NO: 1418) |
| MCL1-2951 21 nt Target: | 5'-CACUAACAGUCAUUGAGAGGU-3' | (SEQ ID NO: 1419) |
| MCL1-3114 21 nt Target: | 5'-UAGGAGUAUGCUCACUUAAAU-3' | (SEQ ID NO: 1420) |
| MCL1-3123 21 nt Target: | 5'-GCUCACUUAAAUUUACAGAAA-3' | (SEQ ID NO: 1421) |
| MCL1-3126 21 nt Target: | 5'-CACUUAAAUUUACAGAAAGAG-3' | (SEQ ID NO: 1422) |
| MCL1-3186 21 nt Target: | 5'-AAACUGAAGAAAGUGUCUAUA-3' | (SEQ ID NO: 1423) |
| MCL1-3207 21 nt Target: | 5'-UUGGAACUAGGGUCAUUUGAA-3' | (SEQ ID NO: 1424) |
| MCL1-3211 21 nt Target: | 5'-AACUAGGGUCAUUUGAAAGCU-3' | (SEQ ID NO: 1425) |
| MCL1-3212 21 nt Target: | 5'-ACUAGGGUCAUUUGAAAGCUU-3' | (SEQ ID NO: 1426) |
| MCL1-3213 21 nt Target: | 5'-CUAGGGUCAUUUGAAAGCUUC-3' | (SEQ ID NO: 1427) |
| MCL1-3214 21 nt Target: | 5'-UAGGGUCAUUUGAAAGCUUCA-3' | (SEQ ID NO: 1428) |
| MCL1-3215 21 nt Target: | 5'-AGGGUCAUUUGAAAGCUUCAG-3' | (SEQ ID NO: 1429) |
| MCL1-3232 21 nt Target: | 5'-UCAGUCUCGGAACAUGACCUU-3' | (SEQ ID NO: 1430) |
| MCL1-3239 21 nt Target: | 5'-CGGAACAUGACCUUUAGUCUG-3' | (SEQ ID NO: 1431) |
| MCL1-3241 21 nt Target: | 5'-GAACAUGACCUUUAGUCUGUG-3' | (SEQ ID NO: 1432) |
| MCL1-3265 21 nt Target: | 5'-UCCAUUUAAAAAUAGGUAUGA-3' | (SEQ ID NO: 1433) |
| MCL1-3277 21 nt Target: | 5'-UAGGUAUGAAUAAGAUGACUA-3' | (SEQ ID NO: 1434) |
| MCL1-3326 21 nt Target: | 5'-CUGCCCAUCUCAGAGCCAUAA-3' | (SEQ ID NO: 1435) |
| MCL1-3370 21 nt Target: | 5'-UUACCUAUGUAUUUAUCGUUC-3' | (SEQ ID NO: 1436) |

TABLE 6-continued

DsiRNA Target Sequences (21mers) In MCL1 mRNA

```
MCL1-3399   21 nt Target:  5'-AAGCCGCUUAUUUAUAUCAUG-3'  (SEQ ID NO: 1437)

MCL1-3446   21 nt Target:  5'-AUGUAGUUUUUAAUUAAUCUU-3'  (SEQ ID NO: 1438)

MCL1-3492   21 nt Target:  5'-AGCCUGUCUGCCAAAUCCAGU-3'  (SEQ ID NO: 1439)

MCL1-3498   21 nt Target:  5'-UCUGCCAAAUCCAGUGGAAAC-3'  (SEQ ID NO: 1440)

MCL1-3508   21 nt Target:  5'-CCAGUGGAAACAAGUGCAUAG-3'  (SEQ ID NO: 1441)

MCL1-3511   21 nt Target:  5'-GUGGAAACAAGUGCAUAGAUG-3'  (SEQ ID NO: 1442)

MCL1-3552   21 nt Target:  5'-CCACUUCCCAAUUCAUUAGGU-3'  (SEQ ID NO: 1443)

MCL1-3568   21 nt Target:  5'-UAGGUAUGACUGUGGAAAUAC-3'  (SEQ ID NO: 1444)

MCL1-3573   21 nt Target:  5'-AUGACUGUGGAAAUACAGACA-3'  (SEQ ID NO: 1445)

MCL1-3574   21 nt Target:  5'-UGACUGUGGAAAUACAGACAA-3'  (SEQ ID NO: 1446)

MCL1-3576   21 nt Target:  5'-ACUGUGGAAAUACAGACAAGG-3'  (SEQ ID NO: 1447)

MCL1-3577   21 nt Target:  5'-CUGUGGAAAUACAGACAAGGA-3'  (SEQ ID NO: 1448)

MCL1-3578   21 nt Target:  5'-UGUGGAAAUACAGACAAGGAU-3'  (SEQ ID NO: 1449)

MCL1-3579   21 nt Target:  5'-GUGGAAAUACAGACAAGGAUC-3'  (SEQ ID NO: 1450)

MCL1-3580   21 nt Target:  5'-UGGAAAUACAGACAAGGAUCU-3'  (SEQ ID NO: 1451)

MCL1-3690   21 nt Target:  5'-GAGGAGGAGGCAGGUGGUCUA-3'  (SEQ ID NO: 1452)

MCL1-3720   21 nt Target:  5'-UGGCUACGUAGUUCGGGCAAA-3'  (SEQ ID NO: 1453)

MCL1-3758   21 nt Target:  5'-GGAGGAUUUGCUUAGAAGGAU-3'  (SEQ ID NO: 1454)

MCL1-3759   21 nt Target:  5'-GAGGAUUUGCUUAGAAGGAUG-3'  (SEQ ID NO: 1455)

MCL1-3844   21 nt Target:  5'-GUCCUCUAGUGUUUCAUGUAC-3'  (SEQ ID NO: 1456)

MCL1-3879   21 nt Target:  5'-GAACACCUUGGUUCUGGUUAA-3'  (SEQ ID NO: 1457)

MCL1-3915   21 nt Target:  5'-AUAGCUGUGCCAGGAAGGGUU-3'  (SEQ ID NO: 1458)

MCL1-3924   21 nt Target:  5'-CCAGGAAGGGUUAGGACCAAC-3'  (SEQ ID NO: 1459)

MCL1-3930   21 nt Target:  5'-AGGGUUAGGACCAACUACAAA-3'  (SEQ ID NO: 1460)

MCL1-m69    21 nt Target:  5'-AGGGAACGGCCUUCCUCACUC-3'  (SEQ ID NO: 1461)

MCL1-m172   21 nt Target:  5'-CUGCGGAGAAACGCGGUCAUC-3'  (SEQ ID NO: 1462)

MCL1-m469   21 nt Target:  5'-CCGGAGGAGGAACUGGACGGC-3'  (SEQ ID NO: 1463)

MCL1-m606   21 nt Target:  5'-CGAGGAGGAAGAGGACGACCU-3'  (SEQ ID NO: 1464)

MCL1-m607   21 nt Target:  5'-GAGGAGGAAGAGGACGACCUA-3'  (SEQ ID NO: 1465)

MCL1-m608   21 nt Target:  5'-AGGAGGAAGAGGACGACCUAU-3'  (SEQ ID NO: 1466)

MCL1-m610   21 nt Target:  5'-GAGGAAGAGGACGACCUAUAC-3'  (SEQ ID NO: 1467)

MCL1-m891   21 nt Target:  5'-CAGGAUUGUGACUCUUAUUUC-3'  (SEQ ID NO: 1468)

MCL1-m924   21 nt Target:  5'-UGUGGCCAAACACUUAAAGAG-3'  (SEQ ID NO: 1469)

MCL1-m925   21 nt Target:  5'-GUGGCCAAACACUUAAAGAGC-3'  (SEQ ID NO: 1470)

MCL1-m926   21 nt Target:  5'-UGGCCAAACACUUAAAGAGCG-3'  (SEQ ID NO: 1471)

MCL1-m939   21 nt Target:  5'-AAAGAGCGUAAACCAAGAAAG-3'  (SEQ ID NO: 1472)

MCL1-m966   21 nt Target:  5'-CGAACCAUUAGCAGAAACUAU-3'  (SEQ ID NO: 1473)

MCL1-m973   21 nt Target:  5'-UUAGCAGAAACUAUCACAGAU-3'  (SEQ ID NO: 1474)

MCL1-m1011  21 nt Target:  5'-ACGGGACUGGCUUGUCAAACA-3'  (SEQ ID NO: 1475)
```

TABLE 6-continued

DsiRNA Target Sequences (21mers) In MCL1 mRNA

MCL1-m1012 21 nt Target: 5'-CGGGACUGGCUUGUCAAACAA-3' (SEQ ID NO: 1476)

MCL1-m1049 21 nt Target: 5'-UUGUGGAGUUCUUCCACGUAC-3' (SEQ ID NO: 1477)

MCL1-m1053 21 nt Target: 5'-GGAGUUCUUCCACGUACAGGA-3' (SEQ ID NO: 1478)

MCL1-m1060 21 nt Target: 5'-UUCCACGUACAGGACCUAGAA-3' (SEQ ID NO: 1479)

MCL1-m1133 21 nt Target: 5'-CUGGUCUGGCAUAUCUAAUAA-3' (SEQ ID NO: 1480)

MCL1-m1193 21 nt Target: 5'-AGCCACCAAACUACAUGCAUC-3' (SEQ ID NO: 1481)

MCL1-m1222 21 nt Target: 5'-CAUGUGUAUUUAUGAAGGUGG-3' (SEQ ID NO: 1482)

MCL1-m1224 21 nt Target: 5'-UGUGUAUUUAUGAAGGUGGAC-3' (SEQ ID NO: 1483)

MCL1-m1227 21 nt Target: 5'-GUAUUUAUGAAGGUGGACUUG-3' (SEQ ID NO: 1484)

MCL1-m1269 21 nt Target: 5'-GUCCAGUUCUACUGUAGCAAC-3' (SEQ ID NO: 1485)

MCL1-m1355 21 nt Target: 5'-CCCUGGAAGAGUCACUGUCUG-3' (SEQ ID NO: 1486)

MCL1-m1356 21 nt Target: 5'-CCUGGAAGAGUCACUGUCUGA-3' (SEQ ID NO: 1487)

MCL1-m1357 21 nt Target: 5'-CUGGAAGAGUCACUGUCUGAA-3' (SEQ ID NO: 1488)

MCL1-m1367 21 nt Target: 5'-CACUGUCUGAAUGAAGCAAAG-3' (SEQ ID NO: 1489)

MCL1-m1388 21 nt Target: 5'-UUCCCUCUCAGCAAACACUGA-3' (SEQ ID NO: 1490)

MCL1-m1389 21 nt Target: 5'-UCCCUCUCAGCAAACACUGAG-3' (SEQ ID NO: 1491)

MCL1-m1395 21 nt Target: 5'-UCAGCAAACACUGAGAGGCCA-3' (SEQ ID NO: 1492)

MCL1-m1401 21 nt Target: 5'-AACACUGAGAGGCCAUGGAGA-3' (SEQ ID NO: 1493)

MCL1-m1409 21 nt Target: 5'-GAGGCCAUGGAGAAGGACUUC-3' (SEQ ID NO: 1494)

MCL1-m1410 21 nt Target: 5'-AGGCCAUGGAGAAGGACUUCU-3' (SEQ ID NO: 1495)

MCL1-m1416 21 nt Target: 5'-UGGAGAAGGACUUCUAGAAUG-3' (SEQ ID NO: 1496)

MCL1-m1420 21 nt Target: 5'-GAAGGACUUCUAGAAUGAAUG-3' (SEQ ID NO: 1497)

MCL1-m1447 21 nt Target: 5'-GUGGAUGGAAAGGUUUGAUUU-3' (SEQ ID NO: 1498)

MCL1-m1491 21 nt Target: 5'-CCAGUCAUCAGGCUAGUCACA-3' (SEQ ID NO: 1499)

MCL1-m1492 21 nt Target: 5'-CAGUCAUCAGGCUAGUCACAA-3' (SEQ ID NO: 1500)

MCL1-m1500 21 nt Target: 5'-AGGCUAGUCACAAAGCUCAAU-3' (SEQ ID NO: 1501)

MCL1-m1556 21 nt Target: 5'-AAGCCCUAAUUAACAACGUUG-3' (SEQ ID NO: 1502)

MCL1-m1601 21 nt Target: 5'-AACCUACAAGUCACCAAACGA-3' (SEQ ID NO: 1503)

MCL1-m1602 21 nt Target: 5'-ACCUACAAGUCACCAAACGAU-3' (SEQ ID NO: 1504)

MCL1-m1609 21 nt Target: 5'-AGUCACCAAACGAUGACUAGA-3' (SEQ ID NO: 1505)

MCL1-m1610 21 nt Target: 5'-GUCACCAAACGAUGACUAGAA-3' (SEQ ID NO: 1506)

MCL1-m1611 21 nt Target: 5'-UCACCAAACGAUGACUAGAAG-3' (SEQ ID NO: 1507)

MCL1-m1612 21 nt Target: 5'-CACCAAACGAUGACUAGAAGC-3' (SEQ ID NO: 1508)

MCL1-m1645 21 nt Target: 5'-CAGGAAUGUGAAGGGAGGCCU-3' (SEQ ID NO: 1509)

MCL1-m1681 21 nt Target: 5'-UGUGCUUGACAAAGUCCCAAG-3' (SEQ ID NO: 1510)

MCL1-m1682 21 nt Target: 5'-GUGCUUGACAAAGUCCCAAGU-3' (SEQ ID NO: 1511)

MCL1-m1686 21 nt Target: 5'-UUGACAAAGUCCCAAGUGCUC-3' (SEQ ID NO: 1512)

MCL1-m1716 21 nt Target: 5'-AGCCCUGUCUACUUUGGCUUG-3' (SEQ ID NO: 1513)

MCL1-m1747 21 nt Target: 5'-UUCUUAAGUUUAUUAGCCUAG-3' (SEQ ID NO: 1514)

TABLE 6-continued

DsiRNA Target Sequences (21mers) In MCL1 mRNA

| | | |
|---|---|---|
| MCL1-m1778 21 nt Target: | 5'-AAAGUACUUGACUUAAGGUUC-3' | (SEQ ID NO: 1515) |
| MCL1-m1902 21 nt Target: | 5'-GAACAUAAGAGGGAAGUCUUG-3' | (SEQ ID NO: 1516) |
| MCL1-m1957 21 nt Target: | 5'-CAGCUUCUCUAGUUAGAAAUG-3' | (SEQ ID NO: 1517) |
| MCL1-m2003 21 nt Target: | 5'-UGUCAUCCGUUCUAGUGUAUA-3' | (SEQ ID NO: 1518) |
| MCL1-m2038 21 nt Target: | 5'-UGUGUGUGGACUGGUUAUAGA-3' | (SEQ ID NO: 1519) |
| MCL1-m2063 21 nt Target: | 5'-UAACUAUGCAGGGUUAAUUAU-3' | (SEQ ID NO: 1520) |
| MCL1-m2110 21 nt Target: | 5'-AUCACAGGUAGAUAGAUGUAA-3' | (SEQ ID NO: 1521) |
| MCL1-m2115 21 nt Target: | 5'-AGGUAGAUAGAUGUAAGACAU-3' | (SEQ ID NO: 1522) |
| MCL1-m2162 21 nt Target: | 5'-GUAAAUGGUAAAGCAGGCUAG-3' | (SEQ ID NO: 1523) |
| MCL1-m2193 21 nt Target: | 5'-AUGGUGCUAUUCACUGGGUUU-3' | (SEQ ID NO: 1524) |
| MCL1-m2262 21 nt Target: | 5'-UUUCUUGUCUACUAAGGAUUG-3' | (SEQ ID NO: 1525) |
| MCL1-m2309 21 nt Target: | 5'-UGGUCUCUAGGUGUAGCCUUU-3' | (SEQ ID NO: 1526) |
| MCL1-m2366 21 nt Target: | 5'-CCCUAUAGAGUCGUCUACACU-3' | (SEQ ID NO: 1527) |
| MCL1-m2375 21 nt Target: | 5'-GUCGUCUACACUUCCUCCCUG-3' | (SEQ ID NO: 1528) |
| MCL1-m2415 21 nt Target: | 5'-UAGUUAUCUGCAUUAGAACUC-3' | (SEQ ID NO: 1529) |
| MCL1-m2482 21 nt Target: | 5'-AUCCUAAUCAGAGUCAGCACA-3' | (SEQ ID NO: 1530) |
| MCL1-m2500 21 nt Target: | 5'-ACAGCUUUCCUGUCAGAGGAU-3' | (SEQ ID NO: 1531) |
| MCL1-m2506 21 nt Target: | 5'-UUCCUGUCAGAGGAUAGGAAC-3' | (SEQ ID NO: 1532) |
| MCL1-m2509 21 nt Target: | 5'-CUGUCAGAGGAUAGGAACACU-3' | (SEQ ID NO: 1533) |
| MCL1-m2510 21 nt Target: | 5'-UGUCAGAGGAUAGGAACACUU-3' | (SEQ ID NO: 1534) |
| MCL1-m2547 21 nt Target: | 5'-GACCGACAGUGACCAGGGAUU-3' | (SEQ ID NO: 1535) |
| MCL1-m2584 21 nt Target: | 5'-CAUGCUUUCCAUUGUUACUUU-3' | (SEQ ID NO: 1536) |
| MCL1-m2651 21 nt Target: | 5'-AAGGUUGGAAAUUAUACGUUU-3' | (SEQ ID NO: 1537) |
| MCL1-m2678 21 nt Target: | 5'-UUAUUAGUUUGCUCCAAGUAU-3' | (SEQ ID NO: 1538) |
| MCL1-m2706 21 nt Target: | 5'-UUCACUUAAGUUUAGAGAAAC-3' | (SEQ ID NO: 1539) |
| MCL1-m2758 21 nt Target: | 5'-CCACUGGUAACUGAAGGUAUU-3' | (SEQ ID NO: 1540) |
| MCL1-m2803 21 nt Target: | 5'-CAGCCUCAGAAUGUGACCUUU-3' | (SEQ ID NO: 1541) |
| MCL1-m2843 21 nt Target: | 5'-AAUAGGCAGGAAUCAAAUGAC-3' | (SEQ ID NO: 1542) |
| MCL1-m2844 21 nt Target: | 5'-AUAGGCAGGAAUCAAAUGACU-3' | (SEQ ID NO: 1543) |
| MCL1-m2845 21 nt Target: | 5'-UAGGCAGGAAUCAAAUGACUA-3' | (SEQ ID NO: 1544) |
| MCL1-m2846 21 nt Target: | 5'-AGGCAGGAAUCAAAUGACUAA-3' | (SEQ ID NO: 1545) |
| MCL1-m2847 21 nt Target: | 5'-GGCAGGAAUCAAAUGACUAAG-3' | (SEQ ID NO: 1546) |
| MCL1-m2848 21 nt Target: | 5'-GCAGGAAUCAAAUGACUAAGA-3' | (SEQ ID NO: 1547) |
| MCL1-m2849 21 nt Target: | 5'-CAGGAAUCAAAUGACUAAGAA-3' | (SEQ ID NO: 1548) |
| MCL1-m2850 21 nt Target: | 5'-AGGAAUCAAAUGACUAAGAAU-3' | (SEQ ID NO: 1549) |
| MCL1-m2859 21 nt Target: | 5'-AUGACUAAGAAUGUAAUAGGG-3' | (SEQ ID NO: 1550) |
| MCL1-m2894 21 nt Target: | 5'-CUGCCAGCUUGGGAGUGAUUU-3' | (SEQ ID NO: 1551) |
| MCL1-m2929 21 nt Target: | 5'-AUCCUUGAUCAUAGUUUGCUU-3' | (SEQ ID NO: 1552) |
| MCL1-m2975 21 nt Target: | 5'-AGAGCACUUUAUGUAGUUGAA-3' | (SEQ ID NO: 1553) |

TABLE 6-continued

DsiRNA Target Sequences (21mers) In MCL1 mRNA

| | | |
|---|---|---|
| MCL1-m2976 21 nt Target: | 5'-GAGCACUUUAUGUAGUUGAAU-3' | (SEQ ID NO: 1554) |
| MCL1-m3055 21 nt Target: | 5'-UUUGUUUACUAGGAGCCUGAC-3' | (SEQ ID NO: 1555) |
| MCL1-m3068 21 nt Target: | 5'-AGCCUGACUUCCCAGCUCACA-3' | (SEQ ID NO: 1556) |
| MCL1-m3069 21 nt Target: | 5'-GCCUGACUUCCCAGCUCACAA-3' | (SEQ ID NO: 1557) |
| MCL1-m3070 21 nt Target: | 5'-CCUGACUUCCCAGCUCACAAA-3' | (SEQ ID NO: 1558) |
| MCL1-m3077 21 nt Target: | 5'-UCCCAGCUCACAAAGGGUGAA-3' | (SEQ ID NO: 1559) |
| MCL1-m3081 21 nt Target: | 5'-AGCUCACAAAGGGUGAAAUGA-3' | (SEQ ID NO: 1560) |
| MCL1-m3104 21 nt Target: | 5'-GCUGAAGUACAGACAGGAUCU-3' | (SEQ ID NO: 1561) |
| MCL1-m3107 21 nt Target: | 5'-GAAGUACAGACAGGAUCUUAG-3' | (SEQ ID NO: 1562) |
| MCL1-m3145 21 nt Target: | 5'-GGGCCAUGAAGACUUGGAGAG-3' | (SEQ ID NO: 1563) |
| MCL1-m3189 21 nt Target: | 5'-CUUUGGAGGGAAGAAGCAUGU-3' | (SEQ ID NO: 1564) |
| MCL1-m3214 21 nt Target: | 5'-UGAGUGCUGACUAGAUGAAUA-3' | (SEQ ID NO: 1565) |
| MCL1-m3219 21 nt Target: | 5'-GCUGACUAGAUGAAUAGUUGA-3' | (SEQ ID NO: 1566) |
| MCL1-m3237 21 nt Target: | 5'-UGAGGCACAUCCUUCAGAGAA-3' | (SEQ ID NO: 1567) |
| MCL1-m3238 21 nt Target: | 5'-GAGGCACAUCCUUCAGAGAAG-3' | (SEQ ID NO: 1568) |
| MCL1-m3265 21 nt Target: | 5'-GGGCUGCUUGGAAAGAUGGCU-3' | (SEQ ID NO: 1569) |
| MCL1-m3294 21 nt Target: | 5'-AAUCUGUUUGUCUUACACGUC-3' | (SEQ ID NO: 1570) |
| MCL1-m3340 21 nt Target: | 5'-CAAGCAUCUUCCAUGUACAUU-3' | (SEQ ID NO: 1571) |
| MCL1-m3390 21 nt Target: | 5'-GAGCACCUAACACUUUAACAG-3' | (SEQ ID NO: 1572) |
| MCL1-m3407 21 nt Target: | 5'-ACAGCUGUUCCCGAAAGGGUU-3' | (SEQ ID NO: 1573) |
| MCL1-m3416 21 nt Target: | 5'-CCCGAAAGGGUUAGGACCAAC-3' | (SEQ ID NO: 1574) |
| MCL1-m3430 21 nt Target: | 5'-GACCAACUGCAAGUUAAUGUG-3' | (SEQ ID NO: 1575) |
| MCL1-872 21 nt Target: | 5'-ACGAAGACGAUGUGAAAUCGU-3' | (SEQ ID NO: 2590) |
| MCL1-941 21 nt Target: | 5'-GCAGGAUUGUGACUCUCAUUU-3' | (SEQ ID NO: 2591) |
| MCL1-943 21 nt Target: | 5'-AGGAUUGUGACUCUCAUUUCU-3' | (SEQ ID NO: 2592) |
| MCL1-965 21 nt Target: | 5'-UUGGUGCCUUUGUGGCUAAAC-3' | (SEQ ID NO: 2593) |
| MCL1-968 21 nt Target: | 5'-GUGCCUUUGUGGCUAAACACU-3' | (SEQ ID NO: 2594) |
| MCL1-1095 21 nt Target: | 5'-UGGGUUUGUGGAGUUCUUCCA-3' | (SEQ ID NO: 2595) |
| MCL1-1308 21 nt Target: | 5'-ACCCUAGCAACCUAGCCAGAA-3' | (SEQ ID NO: 2596) |
| MCL1-1312 21 nt Target: | 5'-UAGCAACCUAGCCAGAAAAGC-3' | (SEQ ID NO: 2597) |
| MCL1-1325 21 nt Target: | 5'-AGAAAAGCAAGUGGCAAGAGG-3' | (SEQ ID NO: 2598) |
| MCL1-1338 21 nt Target: | 5'-GCAAGAGGAUUAUGGCUAACA-3' | (SEQ ID NO: 2599) |
| MCL1-1342 21 nt Target: | 5'-GAGGAUUAUGGCUAACAAGAA-3' | (SEQ ID NO: 2600) |
| MCL1-1344 21 nt Target: | 5'-GGAUUAUGGCUAACAAGAAUA-3' | (SEQ ID NO: 2601) |
| MCL1-1349 21 nt Target: | 5'-AUGGCUAACAAGAAUAAAUAC-3' | (SEQ ID NO: 2602) |
| MCL1-1393 21 nt Target: | 5'-UUGAAGAGUCACUGUCUGAAA-3' | (SEQ ID NO: 2603) |
| MCL1-1397 21 nt Target: | 5'-AGAGUCACUGUCUGAAAGAAG-3' | (SEQ ID NO: 2604) |
| MCL1-1400 21 nt Target: | 5'-GUCACUGUCUGAAAGAAGCAA-3' | (SEQ ID NO: 2605) |
| MCL1-1539 21 nt Target: | 5'-CAGUAGCCAGGCAAGUCAUAG-3' | (SEQ ID NO: 2606) |

TABLE 6-continued

DsiRNA Target Sequences (21mers) In MCL1 mRNA

| | | |
|---|---|---|
| MCL1-1544 21 nt Target: | 5'-GCCAGGCAAGUCAUAGAAUUG-3' | (SEQ ID NO: 2607) |
| MCL1-1562 21 nt Target: | 5'-UUGAUUACCCGCCGAAUUCAU-3' | (SEQ ID NO: 2608) |
| MCL1-1568 21 nt Target: | 5'-ACCCGCCGAAUUCAUUAAUUU-3' | (SEQ ID NO: 2609) |
| MCL1-1573 21 nt Target: | 5'-CCGAAUUCAUUAAUUUACUGU-3' | (SEQ ID NO: 2610) |
| MCL1-1732 21 nt Target: | 5'-GUCCAAGUGUUCAGGACUUUU-3' | (SEQ ID NO: 2611) |
| MCL1-1734 21 nt Target: | 5'-CCAAGUGUUCAGGACUUUUAU-3' | (SEQ ID NO: 2612) |
| MCL1-1740 21 nt Target: | 5'-GUUCAGGACUUUUAUACCUGU-3' | (SEQ ID NO: 2613) |
| MCL1-1742 21 nt Target: | 5'-UCAGGACUUUUAUACCUGUUA-3' | (SEQ ID NO: 2614) |
| MCL1-1746 21 nt Target: | 5'-GACUUUUAUACCUGUUAUACU-3' | (SEQ ID NO: 2615) |
| MCL1-1799 21 nt Target: | 5'-GCCUAGUUUAUCACCAAUAAU-3' | (SEQ ID NO: 2616) |
| MCL1-1822 21 nt Target: | 5'-UUGACGGAAGGCUCAGUAAUU-3' | (SEQ ID NO: 2617) |
| MCL1-1824 21 nt Target: | 5'-GACGGAAGGCUCAGUAAUUAG-3' | (SEQ ID NO: 2618) |
| MCL1-1826 21 nt Target: | 5'-CGGAAGGCUCAGUAAUUAGUU-3' | (SEQ ID NO: 2619) |
| MCL1-1831 21 nt Target: | 5'-GGCUCAGUAAUUAGUUAUGAA-3' | (SEQ ID NO: 2620) |
| MCL1-1833 21 nt Target: | 5'-CUCAGUAAUUAGUUAUGAAUA-3' | (SEQ ID NO: 2621) |
| MCL1-1872 21 nt Target: | 5'-AAGACAGCUUGUAAAUGUAUU-3' | (SEQ ID NO: 2622) |
| MCL1-1875 21 nt Target: | 5'-ACAGCUUGUAAAUGUAUUGU-3' | (SEQ ID NO: 2623) |
| MCL1-1916 21 nt Target: | 5'-CAGAAAGUCUAUUUCUUUGAA-3' | (SEQ ID NO: 2624) |
| MCL1-1948 21 nt Target: | 5'-AUCGAAUUUACAUUAGUUUUU-3' | (SEQ ID NO: 2625) |
| MCL1-1956 21 nt Target: | 5'-UACAUUAGUUUUUUCAUACC-3' | (SEQ ID NO: 2626) |
| MCL1-1958 21 nt Target: | 5'-CAUUAGUUUUUUCAUACCCU-3' | (SEQ ID NO: 2627) |
| MCL1-1969 21 nt Target: | 5'-UUCAUACCCUUUUGAACUUUG-3' | (SEQ ID NO: 2628) |
| MCL1-2021 21 nt Target: | 5'-AGCUUUUCUAUGCUAAACUUU-3' | (SEQ ID NO: 2629) |
| MCL1-2031 21 nt Target: | 5'-UGCUAAACUUUGUUCUGUUCA-3' | (SEQ ID NO: 2630) |
| MCL1-2033 21 nt Target: | 5'-CUAAACUUUGUUCUGUUCAGU-3' | (SEQ ID NO: 2631) |
| MCL1-2087 21 nt Target: | 5'-CUGUAUGCAGACUGGUUGUAG-3' | (SEQ ID NO: 2632) |
| MCL1-2091 21 nt Target: | 5'-AUGCAGACUGGUUGUAGUGGA-3' | (SEQ ID NO: 2633) |
| MCL1-2107 21 nt Target: | 5'-GUGGAACAAAUCUGAUAACUA-3' | (SEQ ID NO: 2634) |
| MCL1-2199 21 nt Target: | 5'-UUGAGAGGUUGAUGAAUGGAA-3' | (SEQ ID NO: 2635) |
| MCL1-2212 21 nt Target: | 5'-GAAUGGAAAUUCUUUCACUUC-3' | (SEQ ID NO: 2636) |
| MCL1-2215 21 nt Target: | 5'-UGGAAAUUCUUUCACUUCAUU-3' | (SEQ ID NO: 2637) |
| MCL1-2217 21 nt Target: | 5'-GAAAUUCUUUCACUUCAUUAU-3' | (SEQ ID NO: 2638) |
| MCL1-2225 21 nt Target: | 5'-UUCACUUCAUUAUAUGCAAGU-3' | (SEQ ID NO: 2639) |
| MCL1-2227 21 nt Target: | 5'-CACUUCAUUAUAUGCAAGUUU-3' | (SEQ ID NO: 2640) |
| MCL1-2230 21 nt Target: | 5'-UUCAUUAUAUGCAAGUUUCA-3' | (SEQ ID NO: 2641) |
| MCL1-2232 21 nt Target: | 5'-CAUUAUAUGCAAGUUUCAAU-3' | (SEQ ID NO: 2642) |
| MCL1-2236 21 nt Target: | 5'-AUAUGCAAGUUUUCAAUAAUU-3' | (SEQ ID NO: 2643) |
| MCL1-2275 21 nt Target: | 5'-AAGGUUACUGAUGACUUACAA-3' | (SEQ ID NO: 2644) |
| MCL1-2304 21 nt Target: | 5'-CUCUGAUUGGGCAAUACUCAU-3' | (SEQ ID NO: 2645) |

TABLE 6-continued

DsiRNA Target Sequences (21mers) In MCL1 mRNA

| | | |
|---|---|---|
| MCL1-2314 21 nt Target: | 5'-GCAAUACUCAUUUGAGUUCCU-3' | (SEQ ID NO: 2646) |
| MCL1-2352 21 nt Target: | 5'-AACUGGUGAAAUUUAAAGUGA-3' | (SEQ ID NO: 2647) |
| MCL1-2473 21 nt Target: | 5'-GACAUUUGAUCCCUUGUUUGC-3' | (SEQ ID NO: 2648) |
| MCL1-2478 21 nt Target: | 5'-UUGAUCCCUUGUUUGCUUAAU-3' | (SEQ ID NO: 2649) |
| MCL1-2483 21 nt Target: | 5'-CCCUUGUUUGCUUAAUAAAUU-3' | (SEQ ID NO: 2650) |
| MCL1-2486 21 nt Target: | 5'-UUGUUUGCUUAAUAAAUUAUA-3' | (SEQ ID NO: 2651) |
| MCL1-2501 21 nt Target: | 5'-AUUAUAAAAUGAUGGCUUGGA-3' | (SEQ ID NO: 2652) |
| MCL1-2575 21 nt Target: | 5'-CAGGUCUAAGCCUAGUAUGUC-3' | (SEQ ID NO: 2653) |
| MCL1-2584 21 nt Target: | 5'-GCCUAGUAUGUCAAUAAAGCA-3' | (SEQ ID NO: 2654) |
| MCL1-2591 21 nt Target: | 5'-AUGUCAAUAAAGCAAAUACUU-3' | (SEQ ID NO: 2655) |
| MCL1-2593 21 nt Target: | 5'-GUCAAUAAAGCAAAUACUUAC-3' | (SEQ ID NO: 2656) |
| MCL1-2596 21 nt Target: | 5'-AAUAAAGCAAAUACUUACUGU-3' | (SEQ ID NO: 2657) |
| MCL1-2598 21 nt Target: | 5'-UAAAGCAAAUACUUACUGUUU-3' | (SEQ ID NO: 2658) |
| MCL1-2602 21 nt Target: | 5'-GCAAAUACUUACUGUUUUGUU-3' | (SEQ ID NO: 2659) |
| MCL1-2605 21 nt Target: | 5'-AAUACUUACUGUUUUGUUUCU-3' | (SEQ ID NO: 2660) |
| MCL1-2607 21 nt Target: | 5'-UACUUACUGUUUUGUUUCUAU-3' | (SEQ ID NO: 2661) |
| MCL1-2609 21 nt Target: | 5'-CUUACUGUUUUGUUUCUAUUA-3' | (SEQ ID NO: 2662) |
| MCL1-2613 21 nt Target: | 5'-CUGUUUUGUUUCUAUUAAUGA-3' | (SEQ ID NO: 2663) |
| MCL1-2625 21 nt Target: | 5'-UAUUAAUGAUUCCCAAACCUU-3' | (SEQ ID NO: 2664) |
| MCL1-2636 21 nt Target: | 5'-CCCAAACCUUGUUGCAAGUUU-3' | (SEQ ID NO: 2665) |
| MCL1-2672 21 nt Target: | 5'-UGGAUUUCAGUCUUGAUGUUU-3' | (SEQ ID NO: 2666) |
| MCL1-2679 21 nt Target: | 5'-CAGUCUUGAUGUUUGUUCUAU-3' | (SEQ ID NO: 2667) |
| MCL1-2790 21 nt Target: | 5'-CCCUGCCAUCCCUGAACUCUU-3' | (SEQ ID NO: 2668) |
| MCL1-2799 21 nt Target: | 5'-CCCUGAACUCUUUCUAGCCCU-3' | (SEQ ID NO: 2669) |
| MCL1-2801 21 nt Target: | 5'-CUGAACUCUUUCUAGCCCUUU-3' | (SEQ ID NO: 2670) |
| MCL1-2911 21 nt Target: | 5'-UUGAUCCUGUUAGCAGGUGGU-3' | (SEQ ID NO: 2671) |
| MCL1-2992 21 nt Target: | 5'-UGGACUGGUAUCUUUUCAACU-3' | (SEQ ID NO: 2672) |
| MCL1-3072 21 nt Target: | 5'-GAAAGAACAUUUUAUGAGGCU-3' | (SEQ ID NO: 2673) |
| MCL1-3074 21 nt Target: | 5'-AAGAACAUUUUAUGAGGCUUU-3' | (SEQ ID NO: 2674) |
| MCL1-3252 21 nt Target: | 5'-UUAGUCUGUGGACUCCAUUUA-3' | (SEQ ID NO: 2675) |
| MCL1-3563 21 nt Target: | 5'-UUCAUUAGGUAUGACUGUGGA-3' | (SEQ ID NO: 2676) |
| MCL1-3588 21 nt Target: | 5'-CAGACAAGGAUCUUAGUUGAU-3' | (SEQ ID NO: 2677) |
| MCL1-3789 21 nt Target: | 5'-GUGACUACUUUUUGACUUCUG-3' | (SEQ ID NO: 2678) |
| MCL1-3989 21 nt Target: | 5'-UUCUGUUUUCCUGAGAAAAA-3' | (SEQ ID NO: 2679) |
| MCL1-3991 21 nt Target: | 5'-CUGUUUUCCUGAGAAAAAAA-3' | (SEQ ID NO: 2680) |
| MCL1-3997 21 nt Target: | 5'-UUCCUGAGAAAAAAAAUAAA-3' | (SEQ ID NO: 2681) |
| MCL1-4000 21 nt Target: | 5'-CUGAGAAAAAAAAUAAAUCU-3' | (SEQ ID NO: 2682) |
| MCL1-4002 21 nt Target: | 5'-GAGAAAAAAAAUAAAUCUUU-3' | (SEQ ID NO: 2683) |

TABLE 6-continued

DsiRNA Target Sequences (21mers) In MCL1 mRNA

MCL1-4008 21 nt Target: 5'-AAAAAAUAAAUCUUUAUUCA-3' (SEQ ID NO: 2684)

MCL1-m1355 21 nt Target: 5'-CCCUGGAAGAGUCACUGUCUG-3' (SEQ ID NO: 2685)

TABLE 7

Selected Human Anti-MCL1 "Blunt/Fray" DsiRNAs

5'-UCGCCACUUCUCACUUCCGCUUCCU$^{CA}$-3' (SEQ ID NO: 1576)
3'-AGCGGUGAAGAGUGAAGGCGAAGGA$_{AG}$-5' (SEQ ID NO: 316)

MCL1-72 Target:
5'-TCGCCACTTCTCACTTCCGCTTCCTTC-3' (SEQ ID NO: 631)

5'-CCACUUCUCACUUCCGCUUCCUUC$^{CA}$-3' (SEQ ID NO: 1577)
3'-GGUGAAGAGUGAAGGCGAAGGAAGG$_{UC}$-5' (SEQ ID NO: 317)

MCL1-75 Target:
5'-CCACTTCTCACTTCCGCTTCCTTCCAG-3' (SEQ ID NO: 632)

5'-GCGGCGGCGACUGGCAAUGUUUGGC$^{AC}$-3' (SEQ ID NO: 1578)
3'-CGCCGCCGCUGACCGUUACAAACCG$_{GA}$-5' (SEQ ID NO: 318)

MCL1-141 Target:
4'-GCGGCGGCGACTGGCAATGTTTGGCCT-3' (SEQ ID NO: 633)

5'-AACGCGGUAAUCGGACUCAACCUCU$^{CA}$-3' (SEQ ID NO: 1579)
3'-UUGCGCCAUUAGCCUGAGUUGGAGA$_{UG}$-5' (SEQ ID NO: 319)

MCL1-175 Target:
5'-AACGCGGTAATCGGACTCAACCTCTAC-3' (SEQ ID NO: 634)

5'-GGAGGGCGACUUUUGGCUACGGAGA$^{CA}$-3' (SEQ ID NO: 1580)
3'-CCUCCCGCUGAAAACCGAUGCCUCU$_{UC}$-5' (SEQ ID NO: 320)

MCL1-250 Target:
5'-GGAGGGCGACTTTTGGCTACGGAGAAG-3' (SEQ ID NO: 635)

5'-CCGCGAGGCUGCUUUUCUUCGCGCC$^{AC}$-3' (SEQ ID NO: 1581)
3'-GGCGCUCCGACGAAAAGAAGCGCGG$_{GU}$-5' (SEQ ID NO: 321)

MCL1-434 Target:
5'-CCGCGAGGCTGCTTTTCTTCGCGCCCA-3' (SEQ ID NO: 636)

5'-UCUGGUAAUAACACCAGUACGGACG$^{AA}$-3' (SEQ ID NO: 1582)
3'-AGACCAUUAUUGUGGUCAUGCCUGC$_{CC}$-5' (SEQ ID NO: 322)

MCL1-604 Target:
5'-TCTGGTAATAACACCAGTACGGACGGG-3' (SEQ ID NO: 637)

5'-GAGGAGGAGGACGAGUUGUACCGGC$^{CA}$-3' (SEQ ID NO: 1583)
3'-CUCCUCCUCCUGCUCAACAUGGCCG$_{UC}$-5' (SEQ ID NO: 323)

MCL1-661 Target:
5'-GAGGAGGAGGACGAGTTGTACCGGCAG-3' (SEQ ID NO: 638)

5'-ACCGGCAGUCGCUGGAGAUUAUCUC$^{CA}$-3' (SEQ ID NO: 1584)
3'-UGGCCGUCAGCGACCUCUAAUAGAG$_{AG}$-5' (SEQ ID NO: 324)

MCL1-680 Target:
5'-ACCGGCAGTCGCTGGAGATTATCTCTC-3' (SEQ ID NO: 639)

5'-GCCAAGGACACAAAGCCAAUGGGCA$^{AA}$-3' (SEQ ID NO: 1585)
3'-CGGUUCCUGUGUUUCGGUUACCCGU$_{CC}$-5' (SEQ ID NO: 325)

TABLE 7-continued

Selected Human Anti-MCL1 "Blunt/Fray" DsiRNAs

MCL1-733 Target:
5'-GCCAAGGACACAAAGCCAATGGGCAGG-3' (SEQ ID NO: 640)

5'-CAGGAAGGCGCUGGAGACCUUACGA$^{AA}$-3' (SEQ ID NO: 1586)
3'-GUCCUUCCGCGACCUCUGGAAUGCU$_{GC}$-5' (SEQ ID NO: 326)

MCL1-774 Target:
5'-CAGGAAGGCGCTGGAGACCTTACGACG-3' (SEQ ID NO: 641)

5'-AUGGCGUGCAGCGCAACCACGAGAC$^{AA}$-3' (SEQ ID NO: 1587)
3'-UACCGCACGUCGCGUUGGUGCUCUG$_{CC}$-5' (SEQ ID NO: 327)

MCL1-809 Target:
5'-ATGGCGTGCAGCGCAACCACGAGACGG-3' (SEQ ID NO: 642)

5'-UGGCGUGCAGCGCAACCACGAGACG$^{AA}$-3' (SEQ ID NO: 1588)
3'-ACCGCACGUCGCGUUGGUGCUCUGC$_{CG}$-5' (SEQ ID NO: 328)

MCL1-810 Target:
5'-TGGCGTGCAGCGCAACCACGAGACGGC-3' (SEQ ID NO: 643)

5'-GGCGUGCAGCGCAACCACGAGACGG$^{AA}$-3' (SEQ ID NO: 1589)
3'-CCGCACGUCGCGUUGGUGCUCUGCC$_{GG}$-5' (SEQ ID NO: 329)

MCL1-811 Target:
5'-GGCGTGCAGCGCAACCACGAGACGGCT-3' (SEQ ID NO: 644)

5'-GCGUGCAGCGCAACCACGAGACGGC$^{AC}$-3' (SEQ ID NO: 1590)
3'-CGCACGUCGCGUUGGUGCUCUGCCG$_{GA}$-5' (SEQ ID NO: 330)

MCL1-812 Target:
5'-GCGTGCAGCGCAACCACGAGACGGCCT-3' (SEQ ID NO: 645)

5'-CGUGCAGCGCAACCACGAGACGGCC$^{CC}$-3' (SEQ ID NO: 1591)
3'-GCACGUCGCGUUGGUGCUCUGCCGG$_{AA}$-5' (SEQ ID NO: 331)

MCL1-813 Target:
5'-CGTGCAGCGCAACCACGAGACGGCCTT-3' (SEQ ID NO: 646)

5'-GUGCAGCGCAACCACGAGACGGCCU$^{CA}$-3' (SEQ ID NO: 1592)
3'-CACGUCGCGUUGGUGCUCUGCCGGA$_{AG}$-5' (SEQ ID NO: 332)

MCL1-814 Target:
5'-GTGCAGCGCAACCACGAGACGGCCTTC-3' (SEQ ID NO: 647)

5'-UGCAGCGCAACCACGAGACGGCCUU$^{AA}$-3' (SEQ ID NO: 1593)
3'-ACGUCGCGUUGGUGCUCUGCCGGAA$_{AG}$-5' (SEQ ID NO: 333)

MCL1-815 Target:
5'-TGCAGCGCAACCACGAGACGGCCTTCC-3' (SEQ ID NO: 648)

5'-GCAGCGCAACCACGAGACGGCCUUC$^{AC}$-3' (SEQ ID NO: 1594)
3'-CGUCGCGUUGGUGCUCUGCCGGAAG$_{GU}$-5' (SEQ ID NO: 334)

TABLE 7-continued

Selected Human Anti-MCL1 "Blunt/Fray" DsiRNAs

MCL1-816 Target:
5'-GCAGCGCAACCACGAGACGGCCTTCCA-3' (SEQ ID NO: 649)

5'-CAGCGCAACCACGAGACGGCCUUCC$^{CC-3'}$ (SEQ ID NO: 1595)
3'-GUCGCGUUGGUGCUCUGCCGGAAGG$_{U-5'}^{U}$ (SEQ ID NO: 335)

MCL1-817 Target:
5'-CAGCGCAACCACGAGACGGCCTTCCAA-3' (SEQ ID NO: 650)

5'-AGCGCAACCACGAGACGGCCUUCCA$^{CA-3'}$ (SEQ ID NO: 1596)
3'-UCGCGUUGGUGCUCUGCCGGAAGGU$_{C-5'}^{U}$ (SEQ ID NO: 336)

MCL1-818 Target:
5'-AGCGCAACCACGAGACGGCCTTCCAAG-3' (SEQ ID NO: 651)

5'-GCGCAACCACGAGACGGCCUUCCAA$^{AA-3'}$ (SEQ ID NO: 1597)
3'-CGCGUUGGUGCUCUGCCGGAAGGUU$_{C-5'}^{C}$ (SEQ ID NO: 337)

MCL1-819 Target:
5'-GCGCAACCACGAGACGGCCTTCCAAGG-3' (SEQ ID NO: 652)

5'-CGCAACCACGAGACGGCCUUCCAAG$^{AA-3'}$ (SEQ ID NO: 1598)
3'-GCGUUGGUGCUCUGCCGGAAGGUUC$_{C-5'}^{C}$ (SEQ ID NO: 338)

MCL1-820 Target:
5'-CGCAACCACGAGACGGCCTTCCAAGGC-3' (SEQ ID NO: 653)

5'-GCAACCACGAGACGGCCUUCCAAGG$^{AC-3'}$ (SEQ ID NO: 1599)
3'-CGUUGGUGCUCUGCCGGAAGGUUCC$_{U-5'}^{G}$ (SEQ ID NO: 339)

MCL1-821 Target:
5'-GCAACCACGAGACGGCCTTCCAAGGCA-3' (SEQ ID NO: 654)

5'-CAACCACGAGACGGCCUUCCAAGGC$^{CC-3'}$ (SEQ ID NO: 1600)
3'-GUUGGUGCUCUGCCGGAAGGUUCCG$_{A-5'}^{U}$ (SEQ ID NO: 340)

MCL1-822 Target:
5'-CAACCACGAGACGGCCTTCCAAGGCAT-3' (SEQ ID NO: 655)

5'-UUCCAAGGCAUGCUUCGGAAACUGG$^{CA-3'}$ (SEQ ID NO: 1601)
3'-AAGGUUCCGUACGAAGCCUUUGACC$_{G-5'}^{U}$ (SEQ ID NO: 341)

MCL1-838 Target:
5'-TTCCAAGGCATGCTTCGGAAACTGGAC-3' (SEQ ID NO: 656)

5'-UCCAAGGCAUGCUUCGGAAACUGGA$^{AC-3'}$ (SEQ ID NO: 1602)
3'-AGGUUCCGUACGAAGCCUUUGACCU$_{U-5'}^{G}$ (SEQ ID NO: 342)

MCL1-839 Target:
5'-TCCAAGGCATGCTTCGGAAACTGGACA-3' (SEQ ID NO: 657)

5'-AACGAAGACGAUGUGAAAUCGUUGU$^{AC-3'}$ (SEQ ID NO: 1603)
3'-UUGCUUCUGCUACACUUUAGCAACA$_{A-5'}^{G}$ (SEQ ID NO: 343)

MCL1-871 Target:
5'-AACGAAGACGATGTGAATCGTTGTCT-3' (SEQ ID NO: 658)

5'-GACGAUGUGAAAUCGUUGUCUCGAG$^{CA-3'}$ (SEQ ID NO: 1604)
3'-CUGCUACACUUUAGCAACAGAGCUC$_{C-5'}^{A}$ (SEQ ID NO: 344)

MCL1-877 Target:
5'-GACGATGTGAAATCGTTGTCTCGAGTG-3' (SEQ ID NO: 659)

5'-GGGCAGGAUUGUGACUCUCAUUUCU$^{CC-3'}$ (SEQ ID NO: 1605)
3'-CCCGUCCUAACACUGAGAGUAAAGA$_{A-5'}^{A}$ (SEQ ID NO: 345)

MCL1-939 Target:
5'-GGGCAGGATTGTGACTCTCATTTCTTT-3' (SEQ ID NO: 660)

5'-UUGUGACUCUCAUUUCUUUUGGUGC$^{AC-3'}$ (SEQ ID NO: 1606)
3'-AACACUGAGAGUAAAGAAAACCACG$_{A-5'}^{G}$ (SEQ ID NO: 346)

MCL1-947 Target:
5'-TTGTGACTCTCATTTCTTTTGGTGCCT-3' (SEQ ID NO: 661)

5'-GCCUUUGUGGCUAAACACUUGAAGA$^{AA-3'}$ (SEQ ID NO: 1607)
3'-CGGAAACACCGAUUUGUGAACUUCU$_{G-5'}^{G}$ (SEQ ID NO: 347)

MCL1-970 Target:
5'-GCCTTTGTGGCTAAACACTTGAAGACC-3' (SEQ ID NO: 662)

5'-UGUGGCUAAACACUUGAAGACCAUA$^{CC-3'}$ (SEQ ID NO: 1608)
3'-ACACCGAUUUGUGAACUUCUGGUAU$_{U-5'}^{U}$ (SEQ ID NO: 348)

MCL1-975 Target:
5'-TGTGGCTAAACACTTGAAGACCATAAA-3' (SEQ ID NO: 663)

5'-GUGGCUAAACACUUGAAGACCAUA$^{CA-3'}$ (SEQ ID NO: 1609)
3'-CACCGAUUUGUGAACUUCUGGUAUU$_{G-5'}^{U}$ (SEQ ID NO: 349)

MCL1-976 Target:
5'-GTGGCTAAACACTTGAAGACCATAAAC-3' (SEQ ID NO: 664)

5'-UGGCUAAACACUUGAAGACCAUAAA$^{AA-3'}$ (SEQ ID NO: 1610)
3'-ACCGAUUUGUGAACUUCUGGUAUUU$_{G-5'}^{G}$ (SEQ ID NO: 350)

MCL1-977 Target:
5'-TGGCTAAACACTTGAAGACCATAAACC-3' (SEQ ID NO: 665)

5'-GGCUAAACACUUGAAGACCAUAAAC$^{AC-3'}$ (SEQ ID NO: 1611)
3'-CCGAUUUGUGAACUUCUGGUAUUUG$_{G-5'}^{G}$ (SEQ ID NO: 351)

MCL1-978 Target:
5'-GGCTAAACACTTGAAGACCATAAACCA-3' (SEQ ID NO: 666)

5'-ACACUUGAAGACCAUAAACCAAGAA$^{CA-3'}$ (SEQ ID NO: 1612)
3'-UGUGAACUUCUGGUAUUUGGUUCUU$_{C-5'}^{U}$ (SEQ ID NO: 352)

MCL1-984 Target:
5'-ACACTTGAAGACCATAAACCAAGAAAG-3' (SEQ ID NO: 667)

5'-CACUUGAAGACCAUAAACCAAGAAA$^{AA-3'}$ (SEQ ID NO: 1613)
3'-GUGAACUUCUGGUAUUUGGUUCUUU$_{C-5'}^{G}$ (SEQ ID NO: 353)

MCL1-985 Target:
5'-CACTTGAAGACCATAAACCAAGAAAGC-3' (SEQ ID NO: 668)

5'-GAAGACCAUAAACCAAGAAAGCUGC$^{CC-3'}$ (SEQ ID NO: 1614)
3'-CUUCUGGUAUUUGGUUCUUUCGACG$_{A-5'}^{U}$ (SEQ ID NO: 354)

MCL1-990 Target:
5'-GAAGACCATAAACCAAGAAAGCTGCAT-3' (SEQ ID NO: 669)

5'-UGCAUCGAACCAUUAGCAGAAAGUA$^{CA-3'}$ (SEQ ID NO: 1615)
3'-ACGUAGCUUGGUAAUCGUCUUUCAU$_{A-5'}^{A}$ (SEQ ID NO: 355)

MCL1-1012 Target:
5'-TGCATCGAACCATTAGCAGAAAGTATC-3' (SEQ ID NO: 670)

5'-GCAUCGAACCAUUAGCAGAAAGUAU$^{AC-3'}$ (SEQ ID NO: 1616)
3'-CGUAGCUUGGUAAUCGUCUUUCAUA$_{G-5'}^{U}$ (SEQ ID NO: 356)

TABLE 7-continued

Selected Human Anti-MCL1 "Blunt/Fray" DsiRNAs

MCL1-1013 Target:
5'-GCATCGAACCATTAGCAGAAAGTATCA-3' (SEQ ID NO: 671)

5'-GAACCAUUAGCAGAAAGUAUCACAGC$^{A-3'}$ (SEQ ID NO: 1617)
3'-CUUGGUAAUCGUCUUUCAUAGUGUC$_{UG-5'}$ (SEQ ID NO: 357)

MCL1-1018 Target:
5'-GAACCATTAGCAGAAAGTATCACAGAC-3' (SEQ ID NO: 672)

5'-ACGGGACUGGCUAGUUAAACAAAGA$^{AA-3'}$ (SEQ ID NO: 1618)
3'-UGCCCUGACCGAUCAAUUUGUUUCU$_{CC-5'}$ (SEQ ID NO: 358)

MCL1-1062 Target:
5'-ACGGGACTGGCTAGTTAAACAAAGAGG-3' (SEQ ID NO: 673)

5'-CGGGACUGGCUAGUUAAACAAAGAG$^{AA-3'}$ (SEQ ID NO: 1619)
3'-GCCCUGACCGAUCAAUUUGUUUCUC$_{CG-5'}$ (SEQ ID NO: 359)

MCL1-1063 Target:
5'-CGGGACTGGCTAGTTAAACAAAGAGGC-3' (SEQ ID NO: 674)

5'-GGCUAGUUAAACAAAGAGGCUGGGA$^{CA-3'}$ (SEQ ID NO: 1620)
3'-CCGAUCAAUUUGUUUCUCCGACCCU$_{AC-5'}$ (SEQ ID NO: 360)

MCL1-1070 Target:
5'-GGCTAGTTAAACAAAGAGGCTGGGATG-3' (SEQ ID NO: 675)

5'-UUAAACAAAGAGGCUGGGAUGGGUU$^{CA-3'}$ (SEQ ID NO: 1621)
3'-AAUUUGUUUCUCCGACCCUACCCAA$_{AC-5'}$ (SEQ ID NO: 361)

MCL1-1076 Target:
5'-TTAAACAAAGAGGCTGGGATGGGTTTG-3' (SEQ ID NO: 676)

5'-UAAACAAAGAGGCUGGGAUGGGUUU$^{AC-3'}$ (SEQ ID NO: 1622)
3'-AUUUGUUUCUCCGACCCUACCCAAA$_{CA-5'}$ (SEQ ID NO: 362)

MCL1-1077 Target:
5'-TAAACAAAGAGGCTGGGATGGGTTTGT-3' (SEQ ID NO: 677)

5'-AAACAAAGAGGCUGGGAUGGGUUUG$^{CA-3'}$ (SEQ ID NO: 1623)
3'-UUUGUUUCUCCGACCCUACCCAAAC$_{AC-5'}$ (SEQ ID NO: 363)

MCL1-1078 Target:
5'-AAACAAAGAGGCTGGGATGGGTTTGTG-3' (SEQ ID NO: 678)

5'-AACAAAGAGGCUGGGAUGGGUUUGU$^{AA-3'}$ (SEQ ID NO: 1624)
3'-UUGUUUCUCCGACCCUACCCAAACA$_{CC-5'}$ (SEQ ID NO: 364)

MCL1-1079 Target:
5'-AACAAAGAGGCTGGGATGGGTTTGTGG-3' (SEQ ID NO: 679)

5'-ACAAAGAGGCUGGGAUGGGUUUGUG$^{AC-3'}$ (SEQ ID NO: 1625)
3'-UGUUUCUCCGACCCUACCCAAACAC$_{CU-5'}$ (SEQ ID NO: 365)

MCL1-1080 Target:
5'-ACAAAGAGGCTGGGATGGGTTTGTGGA-3' (SEQ ID NO: 680)

5'-CAAAGAGGCUGGGAUGGGUUUGUGG$^{CA-3'}$ (SEQ ID NO: 1626)
3'-GUUUCUCCGACCCUACCCAAACACC$_{CU-5'}$ (SEQ ID NO: 366)

MCL1-1081 Target:
5'-CAAAGAGGCTGGGATGGGTTTGTGGAG-3' (SEQ ID NO: 681)

5'-AAAGAGGCUGGGAUGGGUUUGUGGA$^{AC-3'}$ (SEQ ID NO: 1627)
3'-UUUCUCCGACCCUACCCAAACACCU$_{CA-5'}$ (SEQ ID NO: 367)

MCL1-1082 Target:
5'-AAAGAGGCTGGGATGGGTTTGTGGAGT-3' (SEQ ID NO: 682)

5'-AAGAGGCUGGGAUGGGUUUGUGGAG$^{CC-3'}$ (SEQ ID NO: 1628)
3'-UUCUCCGACCCUACCCAAACACCUC$_{AA-5'}$ (SEQ ID NO: 368)

MCL1-1083 Target:
5'-AAGAGGCTGGGATGGGTTTGTGGAGTT-3' (SEQ ID NO: 683)

5'-AGAGGCUGGGAUGGGUUUGUGGAGU$^{CA-3'}$ (SEQ ID NO: 1629)
3'-UCUCCGACCCUACCCAAACACCUCA$_{AG-5'}$ (SEQ ID NO: 369)

MCL1-1084 Target:
5'-AGAGGCTGGGATGGGTTTGTGGAGTTC-3' (SEQ ID NO: 684)

5'-GAGGCUGGGAUGGGUUUGUGGAGUU$^{AC-3'}$ (SEQ ID NO: 1630)
3'-CUCCGACCCUACCCAAACACCUCAA$_{GA-5'}$ (SEQ ID NO: 370)

MCL1-1085 Target:
5'-GAGCTGGGATGGGTTTGTGGAGTTCT-3' (SEQ ID NO: 685)

5'-AGGCUGGGAUGGGUUUGUGGAGUUC$^{CC-3'}$ (SEQ ID NO: 1631)
3'-UCCGACCCUACCCAAACACCUCAAG$_{AA-5'}$ (SEQ ID NO: 371)

MCL1-1086 Target:
5'-AGGCTGGGATGGGTTTGTGGAGTTCTT-3' (SEQ ID NO: 686)

5'-GGCUGGGAUGGGUUUGUGGAGUUCU$^{CA-3'}$ (SEQ ID NO: 1632)
3'-CCGACCCUACCCAAACACCUCAAGA$_{AG-5'}$ (SEQ ID NO: 372)

MCL1-1087 Target:
5'-GGCTGGGATGGGTTTGTGGAGTTCTTC-3' (SEQ ID NO: 687)

5'-GCUGGGAUGGGUUUGUGGAGUUCUU$^{AA-3'}$ (SEQ ID NO: 1633)
3'-CGACCCUACCCAAACACCUCAAGAA$_{GG-5'}$ (SEQ ID NO: 373)

MCL1-1088 Target:
5'-GCTGGGATGGGTTTGTGGAGTTCTTCC-3' (SEQ ID NO: 688)

5'-CUGGGAUGGGUUUGUGGAGUUUCUC$^{AC-3'}$ (SEQ ID NO: 1634)
3'-GACCCUACCCAAACACCUCAAGAAG$_{GU-5'}$ (SEQ ID NO: 374)

MCL1-1089 Target:
5'-CTGGGATGGGTTTGTGGAGTTCTTCCA-3' (SEQ ID NO: 689)

5'-UGGGAUGGGUUUGUGGAGUUCUUCC$^{CC-3'}$ (SEQ ID NO: 1635)
3'-ACCCUACCCAAACACCUCAAGAAGG$_{UA-5'}$ (SEQ ID NO: 375)

MCL1-1090 Target:
5'-TGGGATGGGTTTGTGGAGTTCTTCCAT-3' (SEQ ID NO: 690)

5'-GGGAUGGGUUUGUGGAGUUCUUCCA$^{CA-3'}$ (SEQ ID NO: 1636)
3'-CCCUACCCAAACACCUCAAGAAGGU$_{AC-5'}$ (SEQ ID NO: 376)

MCL1-1091 Target:
5'-GGGATGGGTTTGTGGAGTTCTTCCATG-3' (SEQ ID NO: 691)

5'-GGAUGGGUUUGUGGAGUUUCUUCCU$^{AC-3'}$ (SEQ ID NO: 1637)
3'-CCUACCCAAACACCUCAAGAAGGUA$_{CA-5'}$ (SEQ ID NO: 377)

MCL1-1092 Target:
5'-GGATGGGTTTGTGGAGTTCTTCCATGT-3' (SEQ ID NO: 692)

5'-GAUGGGUUUGUGGAGUUCUUCCAUG$^{CC-3'}$ (SEQ ID NO: 1638)
3'-CUACCCAAACACCUCAAGAAGGUAC$_{AU-5'}$ (SEQ ID NO: 378)

TABLE 7-continued

Selected Human Anti-MCL1 "Blunt/Fray" DsiRNAs

MCL1-1093 Target:
5'-GATGGGTTTGTGGAGTTCTTCCATGTA-3' (SEQ ID NO: 693)

5'-AUGGGUUUGUGGAGUUCUUCCAUGU$^{CA}$-3' (SEQ ID NO: 1639)
3'-UACCCAAACACCUCAAGAAGGUACA$_{UC}$-5' (SEQ ID NO: 379)

MCL1-1094 Target:
5'-ATGGGTTTGTGGAGTTCTTCCATGTAG-3' (SEQ ID NO: 694)

5'-UGGGUUUGUGGAGUUCUUCCAUGUA$^{AC}$-3' (SEQ ID NO: 1640)
3'-ACCCAAACACCUCAAGAAGGUACAU$_{CU}$-5' (SEQ ID NO: 380)

MCL1-1095 Target:
5'-TGGGTTTGTGGAGTTCTTCCATGTAGA-3' (SEQ ID NO: 695)

5'-GGAGUUCUUCCAUGUAGAGGACCUA$^{AC}$-3' (SEQ ID NO: 1641)
3'-CCUCAAGAAGGUACAUCUCCUGGAU$_{CU}$-5' (SEQ ID NO: 381)

MCL1-1104 Target:
5'-GGAGTTCTTCCATGTAGAGGACCTAGA-3' (SEQ ID NO: 696)

5'-UUCCAUGUAGAGGACCUAGAAGGUG$^{AA}$-3' (SEQ ID NO: 1642)
3'-AAGGUACAUCUCCUGGAUCUUCCAC$_{CG}$-5' (SEQ ID NO: 382)

MCL1-1111 Target:
5'-TTCCATGTAGAGGACCTAGAAGGTGGC-3' (SEQ ID NO: 697)

5'-GAGGACCUAGAAGGUGGCAUCAGGA$^{CC}$-3' (SEQ ID NO: 1643)
3'-CUCCUGGAUCUUCCACCGUAGUCCU$_{UA}$-5' (SEQ ID NO: 383)

MCL1-1120 Target:
5'-GAGGACCTAGAAGGTGGCATCAGGAAT-3' (SEQ ID NO: 698)

5'-CAGGUGUUGCUGGAGUAGGAGCUGG$^{CC}$-3' (SEQ ID NO: 1644)
3'-GUCCACAACGACCUCAUCCUCGACC$_{AA}$-5' (SEQ ID NO: 384)

MCL1-1163 Target:
5'-CAGGTGTTGCTGGAGTAGGAGCTGGTT-3' (SEQ ID NO: 699)

5'-AGCUGGUUUGGCAUAUCUAAUAAGA$^{CC}$-3' (SEQ ID NO: 1645)
3'-UCGACCAAACCGUAUAGAUUAUUCU$_{AU}$-5' (SEQ ID NO: 385)

MCL1-1182 Target:
5'-AGCTGGTTTGGCATATCTAATAAGATA-3' (SEQ ID NO: 700)

5'-UUUGGCAUAUCUAAUAAGAUAGCCU$^{CC}$-3' (SEQ ID NO: 1646)
3'-AAACCGUAUAGAUUAUUCUAUCGGA$_{AU}$-5' (SEQ ID NO: 386)

MCL1-1188 Target:
5'-TTTGGCATATCTAATAAGATAGCCTTA-3' (SEQ ID NO: 701)

5'-UUGGCAUAUCUAAUAAGAUAGCCUU$^{CA}$-3' (SEQ ID NO: 1647)
3'-AACCGUAUAGAUUAUUCUAUCGGAA$_{UG}$-5' (SEQ ID NO: 387)

MCL1-1189 Target:
5'-TTGGCATATCTAATAAGATAGCCTTAC-3' (SEQ ID NO: 702)

5'-UGGCAUAUCUAAUAAGAUAGCCUUA$^{AC}$-3' (SEQ ID NO: 1648)
3'-ACCGUAUAGAUUAUUCUAUCGGAAU$_{GA}$-5' (SEQ ID NO: 388)

MCL1-1190 Target:
5'-TGGCATATCTAATAAGATAGCCTTACT-3' (SEQ ID NO: 703)

5'-GGCAUAUCUAAUAAGAUAGCCUUAC$^{CA}$-3' (SEQ ID NO: 1649)
3'-CCGUAUAGAUUAUUCUAUCGGAAUGA$_{AC}$-5' (SEQ ID NO: 389)

MCL1-1191 Target:
5'-GGCATATCTAATAAGATAGCCTTACTG-3' (SEQ ID NO: 704)

5'-GCAUAUCUAAUAAGAUAGCCUUACU$^{AC}$-3' (SEQ ID NO: 1650)
3'-CGUAUAGAUUAUUCUAUCGGAAUGA$_{CA}$-5' (SEQ ID NO: 390)

MCL1-1192 Target:
5'-GCATATCTAATAAGATAGCCTTACTGT-3' (SEQ ID NO: 705)

5'-CAUAUCUAAUAAGAUAGCCUUACUG$^{CC}$-3' (SEQ ID NO: 1651)
3'-GUAUAGAUUAUUCUAUCGGAAUGAC$_{AU}$-5' (SEQ ID NO: 391)

MCL1-1193 Target:
5'-CATATCTAATAAGATAGCCTTACTGTA-3' (SEQ ID NO: 706)

5'-UAGCCUUACUGUAAGUGCAAUAGUU$^{AC}$-3' (SEQ ID NO: 1652)
3'-AUCGGAAUGACAUUCACGUUAUCAA$_{CU}$-5' (SEQ ID NO: 392)

MCL1-1207 Target:
5'-TAGCCTTACTGTAAGTGCAATAGTTGA-3' (SEQ ID NO: 707)

5'-UUGGACUCCAAGCUGUAACUUCCUA$^{AC}$-3' (SEQ ID NO: 1653)
3'-AACCUGAGGUUCGACAUUGAAGGAU$_{CU}$-5' (SEQ ID NO: 393)

MCL1-1276 Target:
5'-TTGGACTCCAAGCTGTAACTTCCTAGA-3' (SEQ ID NO: 708)

5'-ACUUCCUAGAGUUGCACCCUAGCAA$^{AA}$-3' (SEQ ID NO: 1654)
3'-UGAAGGAUCUCAACGUGGGAUCGUU$_{GG}$-5' (SEQ ID NO: 394)

MCL1-1293 Target:
5'-ACTTCCTAGAGTTGCACCCTAGCAACC-3' (SEQ ID NO: 709)

5'-AAGCAAGUGGCAAGAGGAUUAUGGC$^{CC}$-3' (SEQ ID NO: 1655)
3'-UUCGUUCACCGUUCUCCUAAUACCG$_{AU}$-5' (SEQ ID NO: 395)

MCL1-1329 Target:
5'-AAGCAAGTGGCAAGAGGATTATGGCTA-3' (SEQ ID NO: 710)

5'-AGUGGCAAGAGGAUUAUGGCUAACA$^{CA}$-3' (SEQ ID NO: 1656)
3'-UCACCGUUCUCCUAAUACCGAUUGU$_{UC}$-5' (SEQ ID NO: 396)

MCL1-1334 Target:
5'-AGTGGCAAGAGGATTATGGCTAACAAG-3' (SEQ ID NO: 711)

5'-GUGGCAAGAGGAUUAUGGCUAACAA$^{AC}$-3' (SEQ ID NO: 1657)
3'-CACCGUUCUCCUAAUACCGAUUGUU$_{CU}$-5' (SEQ ID NO: 397)

MCL1-1335 Target:
5'-GTGGCAAGAGGATTATGGCTAACAAGA-3' (SEQ ID NO: 712)

5'-AAGAGGAUUAUGGCUAACAAGAAUA$^{CC}$-3' (SEQ ID NO: 1658)
3'-UUCUCCUAAUACCGAUUGUUCUUAU$_{UU}$-5' (SEQ ID NO: 398)

MCL1-1340 Target:
5'-AAGAGGATTATGGCTAACAAGAATAAA-3' (SEQ ID NO: 713)

5'-UAUGGCUAACAAGAAUAAAUACAUG$^{AA}$-3' (SEQ ID NO: 1659)
3'-AUACCGAUUGUUCUUAUUUAUGUAC$_{CC}$-5' (SEQ ID NO: 399)

MCL1-1348 Target:
5'-TATGGCTAACAAGAATAAATACATGGG-3' (SEQ ID NO: 714)

5'-AUGGCUAACAAGAAUAAAUACAUGG$^{AC}$-3' (SEQ ID NO: 1660)
3'-UACCGAUUGUUCUUAUUUAUGUACC$_{CU}$-5' (SEQ ID NO: 400)

TABLE 7-continued

Selected Human Anti-MCL1 "Blunt/Fray" DsiRNAs

MCL1-1349 Target:
5'-ATGGCTAACAAGAATAAATACATGGGA-3' (SEQ ID NO: 715)

5'-UGGCUAACAAGAAUAAAUACAUGGG$^{CC}$-3' (SEQ ID NO: 1661)
3'-ACCGAUUGUUCUUAUUUAUGUACCC$_{U}$-5' (SEQ ID NO: 401)

MCL1-1350 Target:
5'-TGGCTAACAAGAATAAATACATGGGAA-3' (SEQ ID NO: 716)

5'-GGCUAACAAGAAUAAAUACAUGGGA$^{CA}$-3' (SEQ ID NO: 1662)
3'-CCGAUUGUUCUUAUUUAUGUACCCU$_{C}$-5' (SEQ ID NO: 402)

MCL1-1351 Target:
5'-GGCTAACAAGAATAAATACATGGGAAG-3' (SEQ ID NO: 717)

5'-GCUAACAAGAAUAAAUACAUGGGAA$^{AC}$-3' (SEQ ID NO: 1663)
3'-CGAUUGUUCUUAUUUAUGUACCCUU$_{U}$-5' (SEQ ID NO: 403)

MCL1-1352 Target:
5'-GCTAACAAGAATAAATACATGGGAAGA-3' (SEQ ID NO: 718)

5'-CUAACAAGAAUAAAUACAUGGGAAG$^{CA}$-3' (SEQ ID NO: 1664)
3'-GAUUGUUCUUAUUUAUGUACCCUUC$_{U}$-5' (SEQ ID NO: 404)

MCL1-1353 Target:
5'-CTAACAAGAATAAATACATGGGAAGAG-3' (SEQ ID NO: 719)

5'-UAACAAGAAUAAAUACAUGGGAAGA$^{AC}$-3' (SEQ ID NO: 1665)
3'-AUUGUUCUUAUUUAUGUACCCUUCU$_{C}$-5' (SEQ ID NO: 405)

MCL1-1354 Target:
5'-TAACAAGAATAAATACATGGGAAGAGT-3' (SEQ ID NO: 720)

5'-AACAAGAAUAAAUACAUGGGAAGAG$^{CA}$-3' (SEQ ID NO: 1666)
3'-UUGUUCUUAUUUAUGUACCCUUCUC$_{A}$-5' (SEQ ID NO: 406)

MCL1-1355 Target:
5'-AACAAGAATAAATACATGGGAAGAGTG-3' (SEQ ID NO: 721)

5'-ACAAGAAUAAAUACAUGGGAAGAGU$^{AA}$-3' (SEQ ID NO: 1667)
3'-UGUUCUUAUUUAUGUACCCUUCUCA$_{G}$-5' (SEQ ID NO: 407)

MCL1-1356 Target:
5'-ACAAGAATAAATACATGGGAAGAGTGC-3' (SEQ ID NO: 722)

5'-CAAGAAUAAAUACAUGGGAAGAGUG$^{AC}$-3' (SEQ ID NO: 1668)
3'-GUUCUUAUUUAUGUACCCUUCUCAC$_{G}$-5' (SEQ ID NO: 408)

MCL1-1357 Target:
5'-CAAGAATAAATACATGGGAAGAGTGCT-3' (SEQ ID NO: 723)

5'-CCCAUUGAUUGAAGAGUCACUGUCU$^{AC}$-3' (SEQ ID NO: 1669)
3'-GGGUAACUAACUUCUCAGUGACAGA$_{U}$-5' (SEQ ID NO: 409)

MCL1-1385 Target:
5'-CCCATTGATTGAAGAGTCACTGTCTGA-3' (SEQ ID NO: 724)

5'-CACUGUCUGAAAGAAGCAAAGUUCA$^{AC}$-3' (SEQ ID NO: 1670)
3'-GUGACAGACUUUCUUCGUUUCAAGU$_{A}$-5' (SEQ ID NO: 410)

MCL1-1402 Target:
5'-CACTGTCTGAAAGAAGCAAAGTTCAGT-3' (SEQ ID NO: 725)

5'-AAACAAACUUUGUUUGGGAAGCUAU$^{AA}$-3' (SEQ ID NO: 1671)
3'-UUUGUUUGAAACAAACCCUUCGAUA$_{C}$-5' (SEQ ID NO: 411)

MCL1-1438 Target:
5'-AAACAAACTTTGTTTGGGAAGCTATGG-3' (SEQ ID NO: 726)

5'-GGAGGACUUUUAGAUUUAGUGAAGA$^{CA}$-3' (SEQ ID NO: 1672)
3'-CCUCCUGAAAAUCUAAAUCACUUCU$_{A}$-5' (SEQ ID NO: 412)

MCL1-1466 Target:
5'-GGAGGACTTTTAGATTTAGTGAAGATG-3' (SEQ ID NO: 727)

5'-GAAGAUGGUAGGGUGGAAAGACUUA$^{CC}$-3' (SEQ ID NO: 1673)
3'-CUUCUACCAUCCCACCUUUCUGAAU$_{A}$-5' (SEQ ID NO: 413)

MCL1-1486 Target:
5'-GAAGATGGTAGGGTGGAAAGACTTAAT-3' (SEQ ID NO: 728)

5'-UCCUUGUUGAGAACAGGAAAGUGGC$^{AC}$-3' (SEQ ID NO: 1674)
3'-AGGAACAACUCUUGUCCUUUCACCG$_{U}$-5' (SEQ ID NO: 414)

MCL1-1514 Target:
5'-TCCTTGTTGAGAACAGGAAAGTGGCCA-3' (SEQ ID NO: 729)

5'-UAGCCAGGCAAGUCAUAGAAUUGAU$^{CC}$-3' (SEQ ID NO: 1675)
3'-AUCGGUCCGUUCAGUAUCUUAACUA$_{U}$-5' (SEQ ID NO: 415)

MCL1-1542 Target:
5'-TAGCCAGGCAAGTCATAGAATTGATTA-3' (SEQ ID NO: 730)

5'-CCAGGCAAGUCAUAGAAUUGAUUAC$^{AA}$-3' (SEQ ID NO: 1676)
3'-GGUCCGUUCAGUAUCUUAACUAAUG$_{G}$-5' (SEQ ID NO: 416)

MCL1-1545 Target:
5'-CCAGGCAAGTCATAGAATTGATTACCC-3' (SEQ ID NO: 731)

5'-CAGGCAAGUCAUAGAAUUGAUUACC$^{AA}$-3' (SEQ ID NO: 1677)
3'-GUCCGUUCAGUAUCUUAACUAAUGG$_{G}$-5' (SEQ ID NO: 417)

MCL1-1546 Target:
5'-CAGGCAAGTCATAGAATTGATTACCCG-3' (SEQ ID NO: 732)

5'-UACCCGCCGAAUUCAUUAAUUUACU$^{AC}$-3' (SEQ ID NO: 1678)
3'-AUGGGCGGCUUAAGUAAUUAAAUGA$_{C}$-5' (SEQ ID NO: 418)

MCL1-1567 Target:
5'-TACCCGCCGAATTCATTAATTTACTGT-3' (SEQ ID NO: 733)

5'-GCCGAAUUCAUUAAUUUACUGUAGU$^{AC}$-3' (SEQ ID NO: 1679)
3'-CGGCUUAAGUAAUUAAAUGACAUCA$_{C}$-5' (SEQ ID NO: 419)

MCL1-1572 Target:
5'-GCCGAATTCATTAATTTACTGTAGTGT-3' (SEQ ID NO: 734)

5'-UAGUGUUAAGAGAAGCACUAAGAAU$^{AA}$-3' (SEQ ID NO: 1680)
3'-AUCACAAUUCUCUUCGUGAUUCUUA$_{G}$-5' (SEQ ID NO: 420)

MCL1-1593 Target:
5'-TAGTGTTAAGAGAAGCACTAAGAATGC-3' (SEQ ID NO: 735)

5'-GAAGCACUAAGAAUGCCAGUGACCU$^{AC}$-3' (SEQ ID NO: 1681)
3'-CUUCGUGAUUCUUACGGUCACUGGA$_{C}$-5' (SEQ ID NO: 421)

MCL1-1604 Target:
5'-GAAGCACTAAGAATGCCAGTGACCTGT-3' (SEQ ID NO: 736)

5'-ACAAGUAAUAGAACUAUGACUGUAA$^{AA}$-3' (SEQ ID NO: 1682)
3'-UGUUCAUUAUCUUGAUACUGACAUU$_{G}$-5' (SEQ ID NO: 422)

TABLE 7-continued

Selected Human Anti-MCL1 "Blunt/Fray" DsiRNAs

MCL1-1640 Target:
5'-ACAAGTAATAGAACTATGACTGTAAGC-3' (SEQ ID NO: 737)

5'-AAGUAAUAGAACUAUGACUGUAAGC$^{AC}$-3' (SEQ ID NO: 1683)
3'-UUCAUUAUCUUGAUACUGACAUUCG$_{GA}$-5' (SEQ ID NO: 423)

MCL1-1642 Target:
5'-AAGTAATAGAACTATGACTGTAAGCCT-3' (SEQ ID NO: 738)

5'-GCCUCAGUACUGUACAAGGGAAGCU$^{CC}$-3' (SEQ ID NO: 1684)
3'-CGGAGUCAUGACAUGUUCCCUUCGA$_{AA}$-5' (SEQ ID NO: 424)

MCL1-1665 Target:
5'-GCCTCAGTACTGTACAAGGGAAGCTTT-3' (SEQ ID NO: 739)

5'-UCCCAGUAUACUUCUUAGAAAGUCC$^{CC}$-3' (SEQ ID NO: 1685)
3'-AGGGUCAUAUGAAGAAUCUUUCAGG$_{UU}$-5' (SEQ ID NO: 425)

MCL1-1711 Target:
5'-TCCCAGTATACTTCTTAGAAAGTCCAA-3' (SEQ ID NO: 740)

5'-UACCUGUUAUACUUUGGCUUGGUUU$^{AA}$-3' (SEQ ID NO: 1686)
3'-AUGGACAAUAUGAAACCGAACCAAA$_{GG}$-5' (SEQ ID NO: 426)

MCL1-1754 Target:
5'-TACCTGTTATACTTTGGCTTGGTTTCC-3' (SEQ ID NO: 741)

5'-AGCCUAGUUUAUCACCAAUAAUACU$^{CA}$-3' (SEQ ID NO: 1687)
3'-UCGGAUCAAAUAGUGGUUAUUAUGA$_{AC}$-5' (SEQ ID NO: 427)

MCL1-1798 Target:
5'-AGCCTAGTTTATCACCAATAATACTTG-3' (SEQ ID NO: 742)

5'-AUCACCAAUAAUACUUGACGGAAGG$^{AC}$-3' (SEQ ID NO: 1688)
3'-UAGUGGUUAUUAUGAACUGCCUUCC$_{GA}$-5' (SEQ ID NO: 428)

MCL1-1808 Target:
5'-ATCACCAATAATACTTGACGGAAGGCT-3' (SEQ ID NO: 743)

5'-UCACCAAUAAUACUUGACGGAAGGC$^{CA}$-3' (SEQ ID NO: 1689)
3'-AGUGGUUAUUAUGAACUGCCUUCCG$_{AG}$-5' (SEQ ID NO: 429)

MCL1-1809 Target:
5'-TCACCAATAATACTTGACGGAAGGCTC-3' (SEQ ID NO: 744)

5'-CACCAAUAAUACUUGACGGAAGGCU$^{AC}$-3' (SEQ ID NO: 1690)
3'-GUGGUUAUUAUGAACUGCCUUCCGA$_{GU}$-5' (SEQ ID NO: 430)

MCL1-1810 Target:
5'-CACCAATAATACTTGACGGAAGGCTCA-3' (SEQ ID NO: 745)

5'-AAGGCUCAGUAAUUAGUUAUGAAUA$^{CA}$-3' (SEQ ID NO: 1691)
3'-UUCCGAGUCAUUAAUCAAUACUUAU$_{AC}$-5' (SEQ ID NO: 431)

MCL1-1829 Target:
5'-AAGGCTCAGTAATTAGTTATGAATATG-3' (SEQ ID NO: 746)

5'-CUCAGUAAUUAGUUAUGAAUAUGGA$^{CC}$-3' (SEQ ID NO: 1692)
3'-GAGUCAUUAAUCAAUACUUAUACCU$_{AU}$-5' (SEQ ID NO: 432)

MCL1-1833 Target:
5'-CTCAGTAATTAGTTATGAATATGGATA-3' (SEQ ID NO: 747)

5'-AUUCUUAAGACAGCUUGUAAAUGUA$^{CC}$-3' (SEQ ID NO: 1693)
3'-UAAGAAUUCUGUCGAACAUUUACAU$_{AA}$-5' (SEQ ID NO: 433)

TABLE 7-continued

Selected Human Anti-MCL1 "Blunt/Fray" DsiRNAs

MCL1-1866 Target:
5'-ATTCTTAAGACAGCTTGTAAATGTATT-3' (SEQ ID NO: 748)

5'-UGUAAAAAUUGUAUAUAUUUUUACA$^{AC}$-3' (SEQ ID NO: 1694)
3'-ACAUUUUUAACAUAUAUAAAAAUGU$_{CU}$-5' (SEQ ID NO: 434)

MCL1-1893 Target:
5'-TGTAAAAATTGTATATATTTTTACAGA-3' (SEQ ID NO: 749)

5'-UUUACAGAAAGUCUAUUUCUUUGAA$^{CA}$-3' (SEQ ID NO: 1695)
3'-AAAUGUCUUUCAGAUAAAGAAACUU$_{UG}$-5' (SEQ ID NO: 435)

MCL1-1912 Target:
5'-TTTACAGAAAGTCTATTTCTTTGAAAC-3' (SEQ ID NO: 750)

5'-UUACAGAAAGUCUAUUUCUUUGAAA$^{AA}$-3' (SEQ ID NO: 1696)
3'-AAUGUCUUUCAGAUAAAGAAACUUU$_{GC}$-5' (SEQ ID NO: 436)

MCL1-1913 Target:
5'-TTACAGAAAGTCTATTTCTTTGAAACG-3' (SEQ ID NO: 751)

5'-UACAGAAAGUCUAUUUCUUUGAAAC$^{AC}$-3' (SEQ ID NO: 1697)
3'-AUGUCUUUCAGAUAAAGAAACUUUG$_{CU}$-5' (SEQ ID NO: 437)

MCL1-1914 Target:
5'-TACAGAAAGTCTATTTCTTTGAAACGA-3' (SEQ ID NO: 752)

5'-ACAGAAAGUCUAUUUCUUUGAAACG$^{CC}$-3' (SEQ ID NO: 1698)
3'-UGUCUUUCAGAUAAAGAAACUUUGC$_{UU}$-5' (SEQ ID NO: 438)

MCL1-1915 Target:
5'-ACAGAAAGTCTATTTCTTTGAAACGAA-3' (SEQ ID NO: 753)

5'-CAGAAAGUCUAUUUCUUUGAAACGA$^{CA}$-3' (SEQ ID NO: 1699)
3'-GUCUUUCAGAUAAAGAAACUUUGCU$_{UC}$-5' (SEQ ID NO: 439)

MCL1-1916 Target:
5'-CAGAAAGTCTATTTCTTTGAAACGAAG-3' (SEQ ID NO: 754)

5'-AACGAAGGAAGUAUCGAAUUUACAU$^{CC}$-3' (SEQ ID NO: 1700)
3'-UUGCUUCCUUCAUAGCUUAAAUGUA$_{AU}$-5' (SEQ ID NO: 440)

MCL1-1936 Target:
5'-AACGAAGGAAGTATCGAATTTACATTA-3' (SEQ ID NO: 755)

5'-AUCGAAUUUACAUUAGUUUUUUCA$^{CC}$-3' (SEQ ID NO: 1701)
3'-UAGCUUAAAUGUAAUCAAAAAAGU$_{AC}$-5' (SEQ ID NO: 441)

MCL1-1948 Target:
5'-ATCGAATTTACATTAGTTTTTTCATA-3' (SEQ ID NO: 756)

5'-GAACUUUGCAACUUCCGUAAUUAGG$^{CC}$-3' (SEQ ID NO: 1702)
3'-CUUGAAACGUUGAAGGCAUUAAUCC$_{UU}$-5' (SEQ ID NO: 442)

MCL1-1982 Target:
5'-GAACTTTGCAACTTCCGTAATTAGGAA-3' (SEQ ID NO: 757)

5'-AGAGUGUAUACAGAACGAAUUGAUG$^{CA}$-3' (SEQ ID NO: 1703)
3'-UCUCACAUAUGUCUUGCUUAACUAC$_{AC}$-5' (SEQ ID NO: 443)

MCL1-2057 Target:
5'-AGAGTGTATACAGAACGAATTGATGTG-3' (SEQ ID NO: 758)

5'-GUGGAACAAAUCGAUAACUAUGCA$^{AA}$-3' (SEQ ID NO: 1704)
3'-CACCUUGUUUAGACUAUUGAUACGU$_{CC}$-5' (SEQ ID NO: 444)

TABLE 7-continued

Selected Human Anti-MCL1 "Blunt/Fray" DsiRNAs

MCL1-2107 Target:
5'-GTGGAACAAATCTGATAACTATGCAGG-3' (SEQ ID NO: 759)

5'-AAAUUUCUUAUCUGAUUUUGGUAA$^{AC-3'}$ (SEQ ID NO: 1705)
3'-UUUAAAAGAAUAGACUAAAACCAUU$_{CA-5'}$ (SEQ ID NO: 445)

MCL1-2137 Target:
5'-AAATTTTCTTATCTGATTTTGGTAAGT-3' (SEQ ID NO: 760)

5'-UAGGUUUUUCUUUGAAAACCUGGGA$^{CC-3'}$ (SEQ ID NO: 1706)
3'-AUCCAAAAGAAACUUUUGGACCCU$_{AA-5'}$ (SEQ ID NO: 446)

MCL1-2174 Target:
5'-TAGGTTTTTCTTTGAAAACCTGGGATT-3' (SEQ ID NO: 761)

5'-CUGGGAUUGAGAGGUUGAUGAAUGG$^{CC-3'}$ (SEQ ID NO: 1707)
3'-GACCCUAACUCUCCAACUACUUACC$_{UU-5'}$ (SEQ ID NO: 447)

MCL1-2193 Target:
5'-CTGGGATTGAGAGGTTGATGAATGGAA-3' (SEQ ID NO: 762)

5'-UGAGAGGUUGAUGAAUGGAAAUUCU$^{CC-3'}$ (SEQ ID NO: 1708)
3'-ACUCUCCAACUACUUACCUUUAAGA$_{AA-5'}$ (SEQ ID NO: 448)

MCL1-2200 Target:
5'-TGAGAGGTTGATGAATGGAAATTCTTT-3' (SEQ ID NO: 763)

5'-AGGUUGAUGAAUGGAAAUUCUUUCA$^{AC-3'}$ (SEQ ID NO: 1709)
3'-UCCAACUACUUACCUUUAAGAAAGU$_{GA-5'}$ (SEQ ID NO: 449)

MCL1-2204 Target:
5'-AGGTTGATGAATGGAAATTCTTTCACT-3' (SEQ ID NO: 764)

5'-UAUAUGCAAGUUUUCAAUAAUUAGG$^{CA-3'}$ (SEQ ID NO: 1710)
3'-AUAUACGUUCAAAAGUUAUUAAUCC$_{AG-5'}$ (SEQ ID NO: 450)

MCL1-2235 Target:
5'-TATATGCAAGTTTTCAATAATTAGGTC-3' (SEQ ID NO: 765)

5'-AAGGUUACUGAUGACUUACAAAUAA$^{CA-3'}$ (SEQ ID NO: 1711)
3'-UUCCAAUGACUACUGAAUGUUUAUU$_{AC-5'}$ (SEQ ID NO: 451)

MCL1-2275 Target:
5'-AAGGTTACTGATGACTTACAAATAATG-3' (SEQ ID NO: 766)

5'-AUUGGGCAAUACUCAUUUGAGUUCC$^{CC-3'}$ (SEQ ID NO: 1712)
3'-UAACCCGUUAUGAGUAAACUCAAGG$_{AA-5'}$ (SEQ ID NO: 452)

MCL1-2309 Target:
5'-ATTGGGCAATACTCATTTGAGTTCCTT-3' (SEQ ID NO: 767)

5'-UUCCAUUUGACCUAAUUUAACUGGU$^{AC-3'}$ (SEQ ID NO: 1713)
3'-AAGGUAAACUGGAUUAAAUUGACCA$_{CU-5'}$ (SEQ ID NO: 453)

MCL1-2334 Target:
5'-TTCCATTTGACCTAATTTAACTGGTGA-3' (SEQ ID NO: 768)

5'-UUAAAGCUUUUACUAAAAGAUUUUC$^{CA-3'}$ (SEQ ID NO: 1714)
3'-AAUUUCGAAAAUGAUUUUCUAAAAG$_{UC-5'}$ (SEQ ID NO: 454)

MCL1-2389 Target:
5'-TTAAAGCTTTTACTAAAAGATTTTCAG-3' (SEQ ID NO: 769)

5'-CAGGUGGAUGGAGAGACAUUUGAUC$^{AA-3'}$ (SEQ ID NO: 1715)
3'-GUCCACCUACCUCUCUGUAAACUAG$_{GG-5'}$ (SEQ ID NO: 455)

MCL1-2459 Target:
5'-CAGGTGGATGGAGAGACATTTGATCCC-3' (SEQ ID NO: 770)

5'-UGCUUAAUAAAUUAUAAAAUGAUGG$^{AC-3'}$ (SEQ ID NO: 1716)
3'-ACGAAUUAUUUAAUAUUUUACUACC$_{GA-5'}$ (SEQ ID NO: 456)

MCL1-2491 Target:
5'-TGCTTAATAAATTATAAAATGATGGCT-3' (SEQ ID NO: 771)

5'-UAACCAUGGUGCUAUUAUUAGGCUU$^{AA-3'}$ (SEQ ID NO: 1717)
3'-AUUGGUACCACGAUAAUAAUCCGAA$_{CG-5'}$ (SEQ ID NO: 457)

MCL1-2536 Target:
5'-TAACCATGGTGCTATTATTAGGCTTGC-3' (SEQ ID NO: 772)

5'-UAAGCCUAGUAUGUCAAUAAAGCAA$^{CC-3'}$ (SEQ ID NO: 1718)
3'-AUUCGGAUCAUACAGUUAUUUCGUU$_{UA-5'}$ (SEQ ID NO: 458)

MCL1-2581 Target:
5'-TAAGCCTAGTATGTCAATAAAGCAAAT-3' (SEQ ID NO: 773)

5'-UACUGUUUUGUUUCUAUUAAUGAUU$^{AA-3'}$ (SEQ ID NO: 1719)
3'-AUGACAAAACAAAGAUAAUUACUAA$_{GG-5'}$ (SEQ ID NO: 459)

MCL1-2611 Target:
5'-TACTGTTTTGTTTCTATTAATGATTCC-3' (SEQ ID NO: 774)

5'-UUCUAUUAAUGAUUCCCAAACCUUG$^{CC-3'}$ (SEQ ID NO: 1720)
3'-AAGAUAAUUACUAAGGGUUUGGAAC$_{AA-5'}$ (SEQ ID NO: 460)

MCL1-2622 Target:
5'-TTCTATTAATGATTCCCAAACCTTGTT-3' (SEQ ID NO: 775)

5'-CUUGUUGCAAGUUUUUGCAUUGGCA$^{CA-3'}$ (SEQ ID NO: 1721)
3'-GAACAACGUUCAAAAACGUAACCGU$_{AG-5'}$ (SEQ ID NO: 461)

MCL1-2643 Target:
5'-CTTGTTGCAAGTTTTTGCATTGGCATC-3' (SEQ ID NO: 776)

5'-UUGGAUUUCAGUCUUGAUGUUUGUU$^{AC-3'}$ (SEQ ID NO: 1722)
3'-AACCUAAAGUCAGAACUACAAACAA$_{GA-5'}$ (SEQ ID NO: 462)

MCL1-2671 Target:
5'-TTGGATTTCAGTCTTGATGTTTGTTCT-3' (SEQ ID NO: 777)

5'-CUUCCUUGAAAUUGCUGAUUGUUCU$^{AA-3'}$ (SEQ ID NO: 1723)
3'-GAAGGAACUUUAACGACUAACAAGA$_{CG-5'}$ (SEQ ID NO: 463)

MCL1-2725 Target:
5'-CTTCCTTGAAATTGCTGATTGTTCTGC-3' (SEQ ID NO: 778)

5'-GCUCCCUCUACAGAUAUUUAUAUCA$^{CC-3'}$ (SEQ ID NO: 1724)
3'-CGAGGGAGAUGUCUAUAAAUAUAGU$_{UA-5'}$ (SEQ ID NO: 464)

MCL1-2750 Target:
5'-GCTCCCTCTACAGATATTTATATCAAT-3' (SEQ ID NO: 779)

5'-CCACCAAGAGUCCACAGACCUUUCA$^{CA-3'}$ (SEQ ID NO: 1725)
3'-GGUGGUUCUCAGGUGUCUGGAAAGU$_{AG-5'}$ (SEQ ID NO: 465)

MCL1-2874 Target:
5'-CCACCAAGAGTCCACAGACCTTTCATC-3' (SEQ ID NO: 780)

5'-CACCAAGAGUCCACAGACCUUUCAU$^{AC-3'}$ (SEQ ID NO: 1726)
3'-GUGGUUCUCAGGUGUCUGGAAAGUA$_{GA-5'}$ (SEQ ID NO: 466)

TABLE 7-continued

Selected Human Anti-MCL1 "Blunt/Fray" DsiRNAs

MCL1-2875 Target:
5'-CACCAAGAGTCCACAGACCTTTCATCT-3' (SEQ ID NO: 781)

5'-GAGUCCACAGACCUUUCAUCUUUCA$A^{A-3'}$ (SEQ ID NO: 1727)
3'-CUCAGGUGUCUGGAAAGUAGAAAGU$_{GC-5'}$ (SEQ ID NO: 467)

MCL1-2881 Target:
5'-GAGTCCACAGACCTTTCATCTTTCACG-3' (SEQ ID NO: 782)

5'-AGUCCACAGACCUUUCAUCUUUCAC$A^{C-3'}$ (SEQ ID NO: 1728)
3'-UCAGGUGUCUGGAAAGUAGAAAGUG$_{CU-5'}$ (SEQ ID NO: 468)

MCL1-2882 Target:
5'-AGTCCACAGACCTTTCATCTTTCACGA-3' (SEQ ID NO: 783)

5'-GUCCACAGACCUUUCAUCUUUCACG$C^{C-3'}$ (SEQ ID NO: 1729)
3'-CAGGUGUCUGGAAAGUAGAAAGUGC$_{UU-5'}$ (SEQ ID NO: 469)

MCL1-2883 Target:
5'-GTCCACAGACCTTTCATCTTTCACGAA-3' (SEQ ID NO: 784)

5'-UCCACAGACCUUUCAUCUUUCACGA$C^{A-3'}$ (SEQ ID NO: 1730)
3'-AGGUGUCUGGAAAGUAGAAAGUGCU$_{UG-5'}$ (SEQ ID NO: 470)

MCL1-2884 Target:
5'-TCCACAGACCTTTCATCTTTCACGAAC-3' (SEQ ID NO: 785)

5'-ACAGACCUUUCAUCUUUCACGAACU$C^{A-3'}$ (SEQ ID NO: 1731)
3'-UGUCUGGAAAGUAGAAAGUGCUUGA$_{AC-5'}$ (SEQ ID NO: 471)

MCL1-2887 Target:
5'-ACAGACCTTTCATCTTTCACGAACTTG-3' (SEQ ID NO: 786)

5'-GACCUUUCAUCUUUCACGAACUUGA$C^{A-3'}$ (SEQ ID NO: 1732)
3'-CUGGAAAGUAGAAAGUGCUUGAACU$_{UG-5'}$ (SEQ ID NO: 472)

MCL1-2890 Target:
5'-GACCTTTCATCTTTCACGAACTTGATC-3' (SEQ ID NO: 787)

5'-CUGUGACACUAACAGUCAUUGAGAG$A^{C-3'}$ (SEQ ID NO: 1733)
3'-GACACUGUGAUUGUCAGUAACUCUC$_{CA-5'}$ (SEQ ID NO: 473)

MCL1-2945 Target:
5'-CTGTGACACTAACAGTCATTGAGAGGT-3' (SEQ ID NO: 788)

5'-CACUAACAGUCAUUGAGAGGUGGGA$A^{A-3'}$ (SEQ ID NO: 1734)
3'-GUGAUUGUCAGUAACUCUCCACCCU$_{CC-5'}$ (SEQ ID NO: 474)

MCL1-2951 Target:
5'-CACTAACAGTCATTGAGAGGTGGGAGG-3' (SEQ ID NO: 789)

5'-UAGGAGUAUGCUCACUUAAAUUUAC$C^{A-3'}$ (SEQ ID NO: 1735)
3'-AUCCUCAUACGAGUGAAUUUAAAUG$_{UC-5'}$ (SEQ ID NO: 475)

MCL1-3114 Target:
5'-TAGGAGTATGCTCACTTAAATTTACAG-3' (SEQ ID NO: 790)

5'-GCUCACUUAAAUUUACAGAAAGAGG$C^{A-3'}$ (SEQ ID NO: 1736)
3'-CGAGUGAAUUUAAAUGUCUUUCUCC$_{AC-5'}$ (SEQ ID NO: 476)

MCL1-3123 Target:
5'-GCTCACTTAAATTTACAGAAAGAGGTG-3' (SEQ ID NO: 791)

5'-CACUUAAAUUUACAGAAAGAGGUGA$A^{A-3'}$ (SEQ ID NO: 1737)
3'-GUGAAUUUAAAUGUCUUUCUCCACU$_{CG-5'}$ (SEQ ID NO: 477)

MCL1-3126 Target:
5'-CACTTAAATTTACAGAAAGAGGTGAGC-3' (SEQ ID NO: 792)

5'-AAACUGAAGAAAGUGUCUAUAUUGG$C^{C-3'}$ (SEQ ID NO: 1738)
3'-UUUGACUUCUUUCACAGAUAUAACC$_{UU-5'}$ (SEQ ID NO: 478)

MCL1-3186 Target:
5'-AAACTGAAGAAAGTGTCTATATTGGAA-3' (SEQ ID NO: 793)

5'-UUGGAACUAGGGUCAUUUGAAAGCU$C^{C-3'}$ (SEQ ID NO: 1739)
3'-AACCUUGAUCCCAGUAAACUUUCGA$_{AG-5'}$ (SEQ ID NO: 479)

MCL1-3207 Target:
5'-TTGGAACTAGGGTCATTTGAAAGCTTC-3' (SEQ ID NO: 794)

5'-AACUAGGGUCAUUUGAAAGCUUCAG$C^{A-3'}$ (SEQ ID NO: 1740)
3'-UUGAUCCCAGUAAACUUUCGAAGUC$_{AG-5'}$ (SEQ ID NO: 480)

MCL1-3211 Target:
5'-AACTAGGGTCATTTGAAAGCTTCAGTC-3' (SEQ ID NO: 795)

5'-ACUAGGGUCAUUUGAAAGCUUCAGU$A^{C-3'}$ (SEQ ID NO: 1741)
3'-UGAUCCCAGUAAACUUUCGAAGUCA$_{GA-5'}$ (SEQ ID NO: 481)

MCL1-3212 Target:
5'-ACTAGGGTCATTTGAAAGCTTCAGTCT-3' (SEQ ID NO: 796)

5'-CUAGGGUCAUUUGAAAGCUUCAGUC$C^{A-3'}$ (SEQ ID NO: 1742)
3'-GAUCCCAGUAAACUUUCGAAGUCAG$_{AG-5'}$ (SEQ ID NO: 482)

MCL1-3213 Target:
5'-CTAGGGTCATTTGAAAGCTTCAGTCTC-3' (SEQ ID NO: 797)

5'-UAGGGUCAUUUGAAAGCUUCAGUCU$A^{A-3'}$ (SEQ ID NO: 1743)
3'-AUCCCAGUAAACUUUCGAAGUCAGA$_{GC-5'}$ (SEQ ID NO: 483)

MCL1-3214 Target:
5'-TAGGGTCATTTGAAAGCTTCAGTCTCG-3' (SEQ ID NO: 798)

5'-AGGGUCAUUUGAAAGCUUCAGUCUC$A^{A-3'}$ (SEQ ID NO: 1744)
3'-UCCCAGUAAACUUUCGAAGUCAGAG$_{CC-5'}$ (SEQ ID NO: 484)

MCL1-3215 Target:
5'-AGGGTCATTTGAAAGCTTCAGTCTCGG-3' (SEQ ID NO: 799)

5'-UCAGUCUCGGAACAUGACCUUUAGU$A^{C-3'}$ (SEQ ID NO: 1745)
3'-AGUCAGAGCCUUGUACUGGAAAUCA$_{GA-5'}$ (SEQ ID NO: 485)

MCL1-3232 Target:
5'-TCAGTCTCGGAACATGACCTTTAGTCT-3' (SEQ ID NO: 800)

5'-CGGAACAUGACCUUUAGUCUGUGGA$A^{C-3'}$ (SEQ ID NO: 1746)
3'-GCCUUGUACUGGAAAUCAGACACCU$_{GA-5'}$ (SEQ ID NO: 486)

MCL1-3239 Target:
5'-CGGAACATGACCTTTAGTCTGTGGACT-3' (SEQ ID NO: 801)

5'-GAACAUGACCUUUAGUCUGUGGACU$A^{A-3'}$ (SEQ ID NO: 1747)
3'-CUUGUACUGGAAAUCAGACACCUGA$_{GG-5'}$ (SEQ ID NO: 487)

MCL1-3241 Target:
5'-GAACATGACCTTTAGTCTGTGGACTCC-3' (SEQ ID NO: 802)

5'-UCCAUUUAAAAAUAGGUAUGAAUAA$A^{C-3'}$ (SEQ ID NO: 1748)
3'-AGGUAAAUUUUUAUCCAUACUUAUU$_{CU-5'}$ (SEQ ID NO: 488)

TABLE 7-continued

Selected Human Anti-MCL1 "Blunt/Fray" DsiRNAs

MCL1-3265 Target:
5'-TCCATTTAAAAATAGGTATGAATAAGA-3' (SEQ ID NO: 803)

5'-UAGGUAUGAAUAAGAUGACUAAGAAC$^{CA-3'}$ (SEQ ID NO: 1749)
3'-AUCCAUACUUAUUCUACUGAUUCUU$_{AC-5'}$ (SEQ ID NO: 489)

MCL1-3277 Target:
5'-TAGGTATGAATAAGATGACTAAGAATG-3' (SEQ ID NO: 804)

5'-CUGCCCAUCUCAGAGCCAUAAGGUC$^{CC-3'}$ (SEQ ID NO: 1750)
3'-GACGGGUAGAGUCUCGGUAUUCCAG$_{UA-5'}$ (SEQ ID NO: 490)

MCL1-3326 Target:
5'-CTGCCCATCTCAGAGCCATAAGGTCAT-3' (SEQ ID NO: 805)

5'-UUACCUAUGUAUUUAUCGUUCUUGA$^{CA-3'}$ (SEQ ID NO: 1751)
3'-AAUGGAUACAUAAAUAGCAAGAACU$_{AG-5'}$ (SEQ ID NO: 491)

MCL1-3370 Target:
5'-TTACCTATGTATTTATCGTTCTTGATC-3' (SEQ ID NO: 806)

5'-AAGCCGCUUAUUUAUAUCAUGUAUC$^{CA-3'}$ (SEQ ID NO: 1752)
3'-UUCGGCGAAUAAAUAUAGUACAUAG$_{AG-5'}$ (SEQ ID NO: 492)

MCL1-3399 Target:
5'-AAGCCGCTTATTTATATCATGTATCTC-3' (SEQ ID NO: 807)

5'-AUGUAGUUUUUAAUUAAUCUUAAGA$^{CA-3'}$ (SEQ ID NO: 1753)
3'-UACAUCAAAAAUUAAUUAGAAUUCU$_{AG-5'}$ (SEQ ID NO: 493)

MCL1-3446 Target:
5'-ATGTAGTTTTTAATTAATCTTAAGATC-3' (SEQ ID NO: 808)

5'-AGCCUGUCUGCCAAAUCCAGUGGAA$^{CA-3'}$ (SEQ ID NO: 1754)
3'-UCGGACAGACGGUUUAGGUCACCUU$_{UG-5'}$ (SEQ ID NO: 494)

MCL1-3492 Target:
5'-AGCCTGTCTGCCAAATCCAGTGGAAAC-3' (SEQ ID NO: 809)

5'-UCUGCCAAAUCCAGUGGAAACAAGU$^{AA-3'}$ (SEQ ID NO: 1755)
3'-AGACGGUUUAGGUCACCUUUGUUCA$_{CG-5'}$ (SEQ ID NO: 495)

MCL1-3498 Target:
5'-TCTGCCAAATCCAGTGGAAACAAGTGC-3' (SEQ ID NO: 810)

5'-CCAGUGGAAACAAGUGCAUAGAUGU$^{AC-3'}$ (SEQ ID NO: 1756)
3'-GGUCACCUUUGUUCACGUAUCUACA$_{CU-5'}$ (SEQ ID NO: 496)

MCL1-3508 Target:
5'-CCAGTGGAAACAAGTGCATAGATGTGA-3' (SEQ ID NO: 811)

5'-GUGGAAACAAGUGCAUAGAUGUGAA$^{CC-3'}$ (SEQ ID NO: 1757)
3'-CACCUUUGUUCACGUAUCUACACUU$_{AA-5'}$ (SEQ ID NO: 497)

MCL1-3511 Target:
5'-GTGGAAACAAGTGCATAGATGTGAATT-3' (SEQ ID NO: 812)

5'-CCACUUCCCAAUUCAUUAGGUAUGA$^{AC-3'}$ (SEQ ID NO: 1758)
3'-GGUGAAGGGUUAAGUAAUCCAUACU$_{GA-5'}$ (SEQ ID NO: 498)

MCL1-3552 Target:
5'-CCACTTCCCAATTCATTAGGTATGACT-3' (SEQ ID NO: 813)

5'-UAGGUAUGACUGUGGAAAUACAGAC$^{CC-3'}$ (SEQ ID NO: 1759)
3'-AUCCAUACUGACACCUUUAUGUCUG$_{UU-5'}$ (SEQ ID NO: 499)

MCL1-3568 Target:
5'-TAGGTATGACTGTGGAAATACAGACAA-3' (SEQ ID NO: 814)

5'-AUGACUGUGGAAAUACAGACAAGGA$^{CA-3'}$ (SEQ ID NO: 1760)
3'-UACUGACACCUUUAUGUCUGUUCCU$_{AG-5'}$ (SEQ ID NO: 500)

MCL1-3573 Target:
5'-ATGACTGTGGAAATACAGACAAGGATC-3' (SEQ ID NO: 815)

5'-UGACUGUGGAAAUACAGACAAGGAU$^{AC-3'}$ (SEQ ID NO: 1761)
3'-ACUGACACCUUUAUGUCUGUUCCUA$_{GA-5'}$ (SEQ ID NO: 501)

MCL1-3574 Target:
5'-TGACTGTGGAAATACAGACAAGGATCT-3' (SEQ ID NO: 816)

5'-ACUGUGGAAAUACAGACAAGGAUCU$^{CC-3'}$ (SEQ ID NO: 1762)
3'-UGACACCUUUAUGUCUGUUCCUAGA$_{AU-5'}$ (SEQ ID NO: 502)

MCL1-3576 Target:
5'-ACTGTGGAAATACAGACAAGGATCTTA-3' (SEQ ID NO: 817)

5'-CUGUGGAAAUACAGACAAGGAUCUU$^{CA-3'}$ (SEQ ID NO: 1763)
3'-GACACCUUUAUGUCUGUUCCUAGAA$_{UC-5'}$ (SEQ ID NO: 503)

MCL1-3577 Target:
5'-CTGTGGAAATACAGACAAGGATCTTAG-3' (SEQ ID NO: 818)

5'-UGUGGAAAUACAGACAAGGAUCUUA$^{AC-3'}$ (SEQ ID NO: 1764)
3'-ACACCUUUAUGUCUGUUCCUAGAAU$_{CA-5'}$ (SEQ ID NO: 504)

MCL1-3578 Target:
5'-TGTGGAAATACAGACAAGGATCTTAGT-3' (SEQ ID NO: 819)

5'-GUGGAAAUACAGACAAGGAUCUUAG$^{CC-3'}$ (SEQ ID NO: 1765)
3'-CACCUUUAUGUCUGUUCCUAGAAUC$_{AA-5'}$ (SEQ ID NO: 505)

MCL1-3579 Target:
5'-GTGGAAATACAGACAAGGATCTTAGTT-3' (SEQ ID NO: 820)

5'-UGGAAAUACAGACAAGGAUCUUAGU$^{CA-3'}$ (SEQ ID NO: 1766)
3'-ACCUUUAUGUCUGUUCCUAGAAUCA$_{AC-5'}$ (SEQ ID NO: 506)

MCL1-3580 Target:
5'-TGGAAATACAGACAAGGATCTTAGTTG-3' (SEQ ID NO: 821)

5'-GAGGAGGAGGCAGGUGGUCUAAGUG$^{AC-3'}$ (SEQ ID NO: 1767)
3'-CUCCUCCUCCGUCCACCAGAUUCAC$_{GA-5'}$ (SEQ ID NO: 507)

MCL1-3690 Target:
5'-GAGGAGGAGGCAGGTGGTCTAAGTGCT-3' (SEQ ID NO: 822)

5'-UGGCUACGUAGUUCGGGCAAAUCCU$^{AA-3'}$ (SEQ ID NO: 1768)
3'-ACCGAUGCAUCAAGCCCGUUUAGGA$_{GG-5'}$ (SEQ ID NO: 508)

MCL1-3720 Target:
5'-TGGCTACGTAGTTCGGGCAAATCCTCC-3' (SEQ ID NO: 823)

5'-GGAGGAUUUGCUUAGAAGGAUGGCG$^{AC-3'}$ (SEQ ID NO: 1769)
3'-CCUCCUAAACGAAUCUUCCUACCGC$_{GA-5'}$ (SEQ ID NO: 509)

MCL1-3758 Target:
5'-GGAGGATTTGCTTAGAAGGATGGCGCT-3' (SEQ ID NO: 824)

5'-GAGGAUUUGCUUAGAAGGAUGGCGC$^{CA-3'}$ (SEQ ID NO: 1770)
3'-CUCCUAAACGAAUCUUCCUACCGCG$_{AG-5'}$ (SEQ ID NO: 510)

TABLE 7-continued

Selected Human Anti-MCL1 "Blunt/Fray" DsiRNAs

MCL1-3759 Target:
5'-GAGGATTTGCTTAGAAGGATGGCGCTC-3' (SEQ ID NO: 825)

5'-GUCCUCUAGUGUUUCAUGUACAUUC$^{CA-3'}$ (SEQ ID NO: 1771)
3'-CAGGAGAUCACAAAGUACAUGUAAG$_{AC-5'}$ (SEQ ID NO: 511)

MCL1-3844 Target:
5'-GTCCTCTAGTGTTTCATGTACATTCTG-3' (SEQ ID NO: 826)

5'-GAACACCUUGGUUCUGGUUAAACAG$^{AC-3'}$ (SEQ ID NO: 1772)
3'-CUUGUGGAACCAAGACCAAUUUGUC$_{GA-5'}$ (SEQ ID NO: 512)

MCL1-3879 Target:
5'-GAACACCTTGGTTCTGGTTAAACAGCT-3' (SEQ ID NO: 827)

5'-AUAGCUGUGCCAGGAAGGGUUAGGA$^{AA-3'}$ (SEQ ID NO: 1773)
3'-UAUCGACACGGUCCUUCCCAAUCCU$_{GG-5'}$ (SEQ ID NO: 513)

MCL1-3915 Target:
5'-ATAGCTGTGCCAGGAAGGGTTAGGACC-3' (SEQ ID NO: 828)

5'-CCAGGAAGGGUUAGGACCAACUACA$^{CC-3'}$ (SEQ ID NO: 1774)
3'-GGUCCUUCCCAAUCCUGGUUGAUGU$_{UU-5'}$ (SEQ ID NO: 514)

MCL1-3924 Target:
5'-CCAGGAAGGGTTAGGACCAACTACAAA-3' (SEQ ID NO: 829)

5'-AGGGUUAGGACCAACUACAAAUUAA$^{CA-3'}$ (SEQ ID NO: 1775)
3'-UCCCAAUCCUGGUUGAUGUUUAAUU$_{AC-5'}$ (SEQ ID NO: 515)

MCL1-3930 Target:
5'-AGGGTTAGGACCAACTACAAATTAATG-3' (SEQ ID NO: 830)

5'-ACGAAGACGAUGUGAAAUCGUUGUC$^{CA-3'}$ (SEQ ID NO: 2686)
3'-UGCUUCUGCUACACUUUAGCAACAG$_{AG-5'}$ (SEQ ID NO: 2302)

MCL1-872 Target:
5'-ACGAAGACGATGTGAAATCGTTGTCTC-3' (SEQ ID NO: 2398)

5'-GCAGGAUUGUGACUCUCAUUUCUUU$^{CA-3'}$ (SEQ ID NO: 2687)
3'-CGUCCUAACACUGAGAGUAAAGAAA$_{AC-5'}$ (SEQ ID NO: 2303)

MCL1-941 Target:
5'-GCAGGATTGTGACTCTCATTTCTTTTG-3' (SEQ ID NO: 2399)

5'-AGGAUUGUGACUCUCAUUUCUUUUG$^{AC-3'}$ (SEQ ID NO: 2688)
3'-UCCUAACACUGAGAGUAAAGAAAAC$_{CA-5'}$ (SEQ ID NO: 2304)

MCL1-943 Target:
5'-AGGATTGTGACTCTCATTTCTTTTGGT-3' (SEQ ID NO: 2400)

5'-UUGGUGCCUUUGUGGCUAAACACUU$^{AC-3'}$ (SEQ ID NO: 2689)
3'-AACCACGGAAACACCGAUUUGUGAA$_{CU-5'}$ (SEQ ID NO: 2305)

MCL1-965 Target:
5'-TTGGTGCCTTTGTGGCTAAACACTTGA-3' (SEQ ID NO: 2401)

5'-GUGCCUUUGUGGCUAAACACUUGAA$^{AC-3'}$ (SEQ ID NO: 2690)
3'-CACGGAAACACCGAUUUGUGAACUU$_{CU-5'}$ (SEQ ID NO: 2306)

MCL1-968 Target:
5'-GTGCCTTTGTGGCTAAACACTTGAAGA-3' (SEQ ID NO: 2402)

5'-UGGGUUUGUGGAGUUCUUCCAUGUA$^{AC-3'}$ (SEQ ID NO: 2691)
3'-ACCCAAACACCUCAAGAAGGUACAU$_{CU-5'}$ (SEQ ID NO: 2307)

TABLE 7-continued

Selected Human Anti-MCL1 "Blunt/Fray" DsiRNAs

MCL1-1095 Target:
5'-TGGGTTTGTGGAGTTCTTCCATGTAGA-3' (SEQ ID NO: 2403)

5'-ACCCUAGCAACCUAGCCAGAAAAGC$^{CC-3'}$ (SEQ ID NO: 2692)
3'-UGGGAUCGUUGGAUCGGUCUUUUCG$_{UU-5'}$ (SEQ ID NO: 2308)

MCL1-1308 Target:
5'-ACCCTAGCAACCTAGCCAGAAAAGCAA-3' (SEQ ID NO: 2404)

5'-UAGCAACCUAGCCAGAAAAGCAAGU$^{AA-3'}$ (SEQ ID NO: 2693)
3'-AUCGUUGGAUCGGUCUUUUCGUUCA$_{CC-5'}$ (SEQ ID NO: 2309)

MCL1-1312 Target:
5'-TAGCAACCTAGCCAGAAAAGCAAGTGG-3' (SEQ ID NO: 2405)

5'-AGAAAAGCAAGUGGCAAGAGGAUUA$^{CA-3'}$ (SEQ ID NO: 2694)
3'-UCUUUUCGUUCACCGUUCUCCUAAU$_{UC-5'}$ (SEQ ID NO: 2310)

MCL1-1325 Target:
5'-AGAAAAGCAAGTGGCAAGAGGATTATG-3' (SEQ ID NO: 2406)

5'-GCAAGAGGAUUAUGGCUAACAAGAA$^{CC-3'}$ (SEQ ID NO: 2695)
3'-CGUUCUCCUAAUACCGAUUGUUCUU$_{AU-5'}$ (SEQ ID NO: 2311)

MCL1-1338 Target:
5'-GCAAGAGGATTATGGCTAACAAGAATA-3' (SEQ ID NO: 2407)

5'-GAGGAUUAUGGCUAACAAGAAUAAA$^{CC-3'}$ (SEQ ID NO: 2696)
3'-CUCCUAAUACCGAUUGUUCUUAUUU$_{AU-5'}$ (SEQ ID NO: 2312)

MCL1-1342 Target:
5'-GAGGATTATGGCTAACAAGAATAAATA-3' (SEQ ID NO: 2408)

5'-GGAUUAUGGCUAACAAGAAUAAAUA$^{AC-3'}$ (SEQ ID NO: 2697)
3'-CCUAAUACCGAUUGUUCUUAUUUAU$_{GU-5'}$ (SEQ ID NO: 2313)

MCL1-1344 Target:
5'-GGATTATGGCTAACAAGAATAAATACA-3' (SEQ ID NO: 2409)

5'-AUGGCUAACAAGAAUAAAUACAUGG$^{AC-3'}$ (SEQ ID NO: 2698)
3'-UACCGAUUGUUCUUAUUUAUGUACC$_{CU-5'}$ (SEQ ID NO: 2314)

MCL1-1349 Target:
5'-ATGGCTAACAAGAATAAATACATGGGA-3' (SEQ ID NO: 2410)

5'-UUGAAGAGUCACUGUCUGAAAGAAG$^{AC-3'}$ (SEQ ID NO: 2699)
3'-AACUUCUCAGUGACAGACUUUCUUC$_{GU-5'}$ (SEQ ID NO: 2315)

MCL1-1393 Target:
5'-TTGAAGAGTCACTGTCTGAAAGAAGCA-3' (SEQ ID NO: 2411)

5'-AGAGUCACUGUCUGAAAGAAGCAAA$^{AC-3'}$ (SEQ ID NO: 2700)
3'-UCUCAGUGACAGACUUUCUUCGUUU$_{CA-5'}$ (SEQ ID NO: 2316)

MCL1-1397 Target:
5'-AGAGTCACTGTCTGAAAGAAGCAAAGT-3' (SEQ ID NO: 2412)

5'-GUCACUGUCUGAAAGAAGCAAAGUU$^{AC-3'}$ (SEQ ID NO: 2701)
3'-CAGUGACAGACUUUCUUCGUUUCAA$_{GU-5'}$ (SEQ ID NO: 2317)

MCL1-1400 Target:
5'-GTCACTGTCTGAAAGAAGCAAAGTTCA-3' (SEQ ID NO: 2413)

5'-CAGUAGCCAGGCAAGUCUAGAAUU$^{AC-3'}$ (SEQ ID NO: 2702)
3'-GUCAUCGGUCCGUUCAGAUCUUAA$_{CU-5'}$ (SEQ ID NO: 2318)

TABLE 7-continued

Selected Human Anti-MCL1 "Blunt/Fray" DsiRNAs

MCL1-1539 Target:
5'-CAGTAGCCAGGCAAGTCATAGAATTGA-3' (SEQ ID NO: 2414)

5'-GCCAGGCAAGUCAUAGAAUUGAUUA$^{AA}$-3' (SEQ ID NO: 2703)
3'-CGGUCCGUUCAGUAUCUUAACUAAU$_{G}$-5' (SEQ ID NO: 2319)

MCL1-1544 Target:
5'-GCCAGGCAAGTCATAGAATTGATTACC-3' (SEQ ID NO: 2415)

5'-UUGAUUACCCGCCGAAUUCAUUAAU$^{CC}$-3' (SEQ ID NO: 2704)
3'-AACUAAUGGGCGGCUUAAGUAAUUA$_{A}$-5' (SEQ ID NO: 2320)

MCL1-1562 Target:
5'-TTGATTACCCGCCGAATTCATTAATTT-3' (SEQ ID NO: 2416)

5'-ACCCGCCGAAUUCAUUAAUUUACUG$^{CC}$-3' (SEQ ID NO: 2705)
3'-UGGGCGGCUUAAGUAAUUAAAUGAC$_{AU}$-5' (SEQ ID NO: 2321)

MCL1-1568 Target:
5'-ACCCGCCGAATTCATTAATTTACTGTA-3' (SEQ ID NO: 2417)

5'-CCGAAUUCAUUAAUUUACUGUAGUG$^{CC}$-3' (SEQ ID NO: 2706)
3'-GGCUUAAGUAAUUAAAUGACAUCAC$_{A}$-5' (SEQ ID NO: 2322)

MCL1-1573 Target:
5'-CCGAATTCATTAATTTACTGTAGTGTT-3' (SEQ ID NO: 2418)

5'-GUCCAAGUGUUCAGGACUUUUAUAC$^{AC}$-3' (SEQ ID NO: 2707)
3'-CAGGUUCACAAGUCCUGAAAAUAUG$_{GA}$-5' (SEQ ID NO: 2323)

MCL1-1732 Target:
5'-GTCCAAGTGTTCAGGACTTTTATACCT-3' (SEQ ID NO: 2419)

5'-CCAAGUGUUCAGGACUUUUAUACCU$^{AC}$-3' (SEQ ID NO: 2708)
3'-GGUUCACAAGUCCUGAAAAUAUGGA$_{CA}$-5' (SEQ ID NO: 2324)

MCL1-1734 Target:
5'-CCAAGTGTTCAGGACTTTTATACCTGT-3' (SEQ ID NO: 2420)

5'-GUUCAGGACUUUUAUACCUGUUAUA$^{AC}$-3' (SEQ ID NO: 2709)
3'-CAAGUCCUGAAAAUAUGGACAAUAU$_{GA}$-5' (SEQ ID NO: 2325)

MCL1-1740 Target:
5'-GTTCAGGACTTTTATACCTGTTATACT-3' (SEQ ID NO: 2421)

5'-UCAGGACUUUUAUACCUGUUAUACU$^{CC}$-3' (SEQ ID NO: 2710)
3'-AGUCCUGAAAAUAUGGACAAUAUGA$_{AA}$-5' (SEQ ID NO: 2326)

MCL1-1742 Target:
5'-TCAGGACTTTTATACCTGTTATACTTT-3' (SEQ ID NO: 2422)

5'-GACUUUUAUACCUGUUAUACUUUGA$^{AC}$-3' (SEQ ID NO: 2711)
3'-CUGAAAAUAUGGACAAUAUGAAACC$_{GA}$-5' (SEQ ID NO: 2327)

MCL1-1746 Target:
5'-GACTTTTATACCTGTTATACTTTGGCT-3' (SEQ ID NO: 2423)

5'-GCCUAGUUUAUCACCAAUAAUACUU$^{AC}$-3' (SEQ ID NO: 2712)
3'-CGGAUCAAAUAGUGGUUAUUAUGAA$_{CU}$-5' (SEQ ID NO: 2328)

MCL1-1799 Target:
5'-GCCTAGTTTATCACCAATAATACTTGA-3' (SEQ ID NO: 2424)

5'-UUGACGGAAGGCUCAGUAAUUAGUU$^{CC}$-3' (SEQ ID NO: 2713)
3'-AACUGCCUUCCGAGUCAUUAAUCAA$_{AU}$-5' (SEQ ID NO: 2329)

TABLE 7-continued

Selected Human Anti-MCL1 "Blunt/Fray" DsiRNAs

MCL1-1822 Target:
5'-TTGACGGAAGGCTCAGTAATTAGTTAT-3' (SEQ ID NO: 2425)

5'-GACGGAAGGCUCAGUAAUUAGUUAU$^{AC}$-3' (SEQ ID NO: 2714)
3'-CUGCCUUCCGAGUCAUUAAUCAAUA$_{CU}$-5' (SEQ ID NO: 2330)

MCL1-1824 Target:
5'-GACGGAAGGCTCAGTAATTAGTTATGA-3' (SEQ ID NO: 2426)

5'-CGGAAGGCUCAGUAAUUAGUUAUGA$^{CC}$-3' (SEQ ID NO: 2715)
3'-GCCUUCCGAGUCAUUAAUCAAUACU$_{UA}$-5' (SEQ ID NO: 2331)

MCL1-1826 Target:
5'-CGGAAGGCTCAGTAATTAGTTATGAAT-3' (SEQ ID NO: 2427)

5'-GGCUCAGUAAUUAGUUAUGAAUAUG$^{AC}$-3' (SEQ ID NO: 2716)
3'-CCGAGUCAUUAAUCAAUACUUAUAC$_{CU}$-5' (SEQ ID NO: 2332)

MCL1-1831 Target:
5'-GGCTCAGTAATTAGTTATGAATATGGA-3' (SEQ ID NO: 2428)

5'-CUCAGUAAUUAGUUAUGAAUAUGGA$^{CC}$-3' (SEQ ID NO: 2717)
3'-GAGUCAUUAAUCAAUACUUAUACCU$_{AU}$-5' (SEQ ID NO: 2333)

MCL1-1833 Target:
5'-CTCAGTAATTAGTTATGAATATGGATA-3' (SEQ ID NO: 2429)

5'-AAGACAGCUUGUAAAUGUAUUUGUA$^{CC}$-3' (SEQ ID NO: 2718)
3'-UUCUGUCGAACAUUUACAUAAACAU$_{UU}$-5' (SEQ ID NO: 2334)

MCL1-1872 Target:
5'-AAGACAGCTTGTAAATGTATTTGTAAA-3' (SEQ ID NO: 2430)

5'-ACAGCUUGUAAAUGUAUUUGUAAAA$^{CC}$-3' (SEQ ID NO: 2719)
3'-UGUCGAACAUUUACAUAAACAUUUU$_{UA}$-5' (SEQ ID NO: 2335)

MCL1-1875 Target:
5'-ACAGCTTGTAAATGTATTTGTAAAAAT-3' (SEQ ID NO: 2431)

5'-CAGAAAGUCUAUUUCUUUGAAACGA$^{CA}$-3' (SEQ ID NO: 2720)
3'-GUCUUUCAGAUAAAGAAACUUUGCU$_{UC}$-5' (SEQ ID NO: 2336)

MCL1-1916 Target:
5'-CAGAAAGTCTATTTCTTTGAAACGAAG-3' (SEQ ID NO: 2432)

5'-AUCGAAUUUACAUUAGUUUUUUUCA$^{CC}$-3' (SEQ ID NO: 2721)
3'-UAGCUUAAAUGUAAUCAAAAAAAGU$_{AU}$-5' (SEQ ID NO: 2337)

MCL1-1948 Target:
5'-ATCGAATTTACATTAGTTTTTTTCATA-3' (SEQ ID NO: 2433)

5'-UACAUUAGUUUUUUUCAUACCCUUU$^{CA}$-3' (SEQ ID NO: 2722)
3'-AUGUAAUCAAAAAAAGUAUGGGAAA$_{AC}$-5' (SEQ ID NO: 2338)

MCL1-1956 Target:
5'-TACATTAGTTTTTTTCATACCCTTTG-3' (SEQ ID NO: 2434)

5'-CAUUAGUUUUUUUCAUACCCUUUUG$^{CC}$-3' (SEQ ID NO: 2723)
3'-GUAAUCAAAAAAAGUAUGGGAAAAC$_{UU}$-5' (SEQ ID NO: 2339)

MCL1-1958 Target:
5'-CATTAGTTTTTTTCATACCCTTTTGAA-3' (SEQ ID NO: 2435)

5'-UUCAUACCCUUUUGAACUUUGCAAC$^{CC}$-3' (SEQ ID NO: 2724)
3'-AAGUAUGGGAAAACUUGAAACGUUG$_{A}$-5' (SEQ ID NO: 2340)

TABLE 7-continued

Selected Human Anti-MCL1 "Blunt/Fray" DsiRNAs

MCL1-1969 Target:
5'-TTCATACCCTTTTGAACTTTGCAACTT-3' (SEQ ID NO: 2436)

5'-AGCUUUUCUAUGCUAAACUUUGUUCC$^{\text{A}}$A-3' (SEQ ID NO: 2725)
3'-UCGAAAAGAUACGAUUUGAAACAAG$_{\text{A}}$$_{\text{C-5'}}$ (SEQ ID NO: 2341)

MCL1-2021 Target:
5'-AGCTTTTCTATGCTAAACTTTGTTCTG-3' (SEQ ID NO: 2437)

5'-UGCUAAACUUUGUUCUGUUCAGUUC$^{\text{C}}$C-3' (SEQ ID NO: 2726)
3'-ACGAUUUGAAACAAGACAAGUCAAG$_{\text{A}}$$_{\text{U-5'}}$ (SEQ ID NO: 2342)

MCL1-2031 Target:
5'-TGCTAAACTTTGTTCTGTTCAGTTCTA-3' (SEQ ID NO: 2438)

5'-CUAAACUUUGUUCUGUUCAGUUCUA$^{\text{A}}$C-3' (SEQ ID NO: 2727)
3'-GAUUUGAAACAAGACAAGUCAAGAU$_{\text{C}}$$_{\text{U-5'}}$ (SEQ ID NO: 2343)

MCL1-2033 Target:
5'-CTAAACTTTGTTCTGTTCAGTTCTAGA-3' (SEQ ID NO: 2439)

5'-CUGUAUGCAGACUGGUUGUAGUGGA$^{\text{C}}$A-3' (SEQ ID NO: 2728)
3'-GACAUACGUCUGACCAACAUCACCU$_{\text{G}}$$_{\text{U-5'}}$ (SEQ ID NO: 2344)

MCL1-2087 Target:
5'-CTGTATGCAGACTGGTTGTAGTGGAAC-3' (SEQ ID NO: 2440)

5'-AUGCAGACUGGUUGUAGUGGAACAA$^{\text{C}}$C-3' (SEQ ID NO: 2729)
3'-UACGUCUGACCAACAUCACCUUGUU$_{\text{U}}$$_{\text{A-5'}}$ (SEQ ID NO: 2345)

MCL1-2091 Target:
5'-ATGCAGACTGGTTGTAGTGGAACAAT-3' (SEQ ID NO: 2441)

5'-GUGGAACAAAUCUGAUAACUAUGCA$^{\text{A}}$A-3' (SEQ ID NO: 2730)
3'-CACCUUGUUUAGACUAUUGAUACGU$_{\text{C-5'}}$ (SEQ ID NO: 2346)

MCL1-2107 Target:
5'-GTGGAACAAATCTGATAACTATGCAGG-3' (SEQ ID NO: 2442)

5'-UUGAGAGGUUGAUGAAUGGAAAUUC$^{\text{C}}$C-3' (SEQ ID NO: 2731)
3'-AACUCUCCAACUACUUACCUUUAAG$_{\text{A}}$$_{\text{A-5'}}$ (SEQ ID NO: 2347)

MCL1-2199 Target:
5'-TTGAGAGGTTGATGAATGGAAATTCTT-3' (SEQ ID NO: 2443)

5'-GAAUGGAAAUUCUUUCACUUCAUUA$^{\text{C}}$C-3' (SEQ ID NO: 2732)
3'-CUUACCUUUAAGAAAGUGAAGUAAU$_{\text{A}}$$_{\text{U-5'}}$ (SEQ ID NO: 2348)

MCL1-2212 Target:
5'-GAATGGAAATTCTTTCACTTCATTATA-3' (SEQ ID NO: 2444)

5'-UGGAAAUUCUUUCACUUCAUUAUAU$^{\text{A}}$A-3' (SEQ ID NO: 2733)
3'-ACCUUUAAGAAAGUGAAGUAAUAUA$_{\text{G-5'}}$ (SEQ ID NO: 2349)

MCL1-2215 Target:
5'-TGGAAATTCTTTCACTTCATTATATGC-3' (SEQ ID NO: 2445)

5'-GAAAUUCUUUCACUUCAUUAUAUGC$^{\text{C}}$C-3' (SEQ ID NO: 2734)
3'-CUUUAAGAAAGUGAAGUAAUAUACG$_{\text{U}}$$_{\text{U-5'}}$ (SEQ ID NO: 2350)

MCL1-2217 Target:
5'-GAAATTCTTTCACTTCATTATATGCAA-3' (SEQ ID NO: 2446)

5'-UUCACUUCAUUAUAUGCAAGUUUUC$^{\text{C}}$C-3' (SEQ ID NO: 2735)
3'-AAGUGAAGUAAUAUACGUUCAAAAG$_{\text{U}}$$_{\text{U-5'}}$ (SEQ ID NO: 2351)

MCL1-2225 Target:
5'-TTCACTTCATTATATGCAAGTTTTCAA-3' (SEQ ID NO: 2447)

5'-CACUUCAUUAUAUGCAAGUUUUCAA$^{\text{C}}$C-3' (SEQ ID NO: 2736)
3'-GUGAAGUAAUAUACGUUCAAAAGUU$_{\text{A}}$$_{\text{U-5'}}$ (SEQ ID NO: 2352)

MCL1-2227 Target:
5'-CACTTCATTATATGCAAGTTTTCAATA-3' (SEQ ID NO: 2448)

5'-UUCAUUAUAUGCAAGUUUUCAAUAA$^{\text{C}}$C-3' (SEQ ID NO: 2737)
3'-AAGUAAUAUACGUUCAAAAGUUAUU$_{\text{A}}$$_{\text{A-5'}}$ (SEQ ID NO: 2353)

MCL1-2230 Target:
5'-TTCATTATATGCAAGTTTTCAATAATT-3' (SEQ ID NO: 2449)

5'-CAUUAUAUGCAAGUUUUCAAUAAUU$^{\text{A}}$A-3' (SEQ ID NO: 2738)
3'-GUAAUAUACGUUCAAAAGUUAUUAA$_{\text{U}}$$_{\text{C-5'}}$ (SEQ ID NO: 2354)

MCL1-2232 Target:
5'-CATTATATGCAAGTTTTCAATAATTAG-3' (SEQ ID NO: 2450)

5'-AUAUGCAAGUUUUCAAUAAUUAGGU$^{\text{A}}$A-3' (SEQ ID NO: 2739)
3'-UAUACGUUCAAAAGUUAUUAAUCCA$_{\text{G}}$$_{\text{A-5'}}$ (SEQ ID NO: 2355)

MCL1-2236 Target:
5'-ATATGCAAGTTTTCAATAATTAGGTCT-3' (SEQ ID NO: 2451)

5'-AAGGUUACUGAUGACUUACAAAUAA$^{\text{C}}$A-3' (SEQ ID NO: 2740)
3'-UUCCAAUGACUACUGAAUGUUUAUU$_{\text{U}}$$_{\text{C-5'}}$ (SEQ ID NO: 2356)

MCL1-2275 Target:
5'-AAGGTTACTGATGACTTACAAATAATG-3' (SEQ ID NO: 2452)

5'-CUCUGAUUGGGCAAUACUCAUUUGA$^{\text{A}}$C-3' (SEQ ID NO: 2741)
3'-GAGACUAACCCGUUAUGAGUAAACU$_{\text{C}}$$_{\text{A-5'}}$ (SEQ ID NO: 2357)

MCL1-2304 Target:
5'-CTCTGATTGGGCAATACTCATTTGAGT-3' (SEQ ID NO: 2453)

5'-GCAAUACUCAUUUGAGUUCCUUCCA$^{\text{C}}$C-3' (SEQ ID NO: 2742)
3'-CGUUAUGAGUAAACUCAAGGAAGGU$_{\text{A}}$$_{\text{A-5'}}$ (SEQ ID NO: 2358)

MCL1-2314 Target:
5'-GCAATACTCATTTGAGTTCCTTCCATT-3' (SEQ ID NO: 2554)

5'-AACUGGUGAAAUUUAAAGUGAAUUC$^{\text{C}}$C-3' (SEQ ID NO: 2743)
3'-UUGACCACUUUAAAUUUCACUUAAG$_{\text{U}}$$_{\text{A-5'}}$ (SEQ ID NO: 2359)

MCL1-2352 Target:
5'-AACTGGTGAAATTTAAAGTGAATTCAT-3' (SEQ ID NO: 2455)

5'-GACAUUUGAUCCCUUGUUUGCUUAA$^{\text{C}}$C-3' (SEQ ID NO: 2744)
3'-CUGUAAACUAGGGAACAAACGAAUU$_{\text{A}}$$_{\text{U-5'}}$ (SEQ ID NO: 2360)

MCL1-2473 Target:
5'-GACATTTGATCCCTTGTTTGCTTAATA-3' (SEQ ID NO: 2456)

5'-UUGAUCCCUUGUUUGCUUAAUAAAU$^{\text{C}}$C-3' (SEQ ID NO: 2745)
3'-AACUAGGGAACAAACGAAUUAUUUA$_{\text{A}}$$_{\text{U-5'}}$ (SEQ ID NO: 2361)

MCL1-2478 Target:
5'-TTGATCCCTTGTTTGCTTAATAAATTA-3' (SEQ ID NO: 2457)

5'-CCCUUGUUUGCUUAAUAAAUUAUAA$^{\text{C}}$C-3' (SEQ ID NO: 2746)
3'-GGGAACAAACGAAUUAUUUAAUAUU$_{\text{U}}$$_{\text{U-5'}}$ (SEQ ID NO: 2362)

TABLE 7-continued

Selected Human Anti-MCL1 "Blunt/Fray" DsiRNAs

MCL1-2483 Target:
5'-CCCTTGTTTGCTTAATAAATTATAAAA-3' (SEQ ID NO: 2458)

5'-UUGUUUGCUUAAUAAAUUAUAAAAU$^{AC-3'}$ (SEQ ID NO: 2747)
3'-AACAAACGAAUUAUUUAAUAUUUUA$_{CU-5'}$ (SEQ ID NO: 2363)

MCL1-2486 Target:
5'-TTGTTTGCTTAATAAATTATAAAATGA-3' (SEQ ID NO: 2459)

5'-AUUAUAAAAUGAUGGCUUGGAAAAG$^{AC-3'}$ (SEQ ID NO: 2748)
3'-UAAUAUUUUACUACCGAACCUUUUC$_{GU-5'}$ (SEQ ID NO: 2364)

MCL1-2501 Target:
5'-ATTATAAAATGATGGCTTGGAAAAGCA-3' (SEQ ID NO: 2460)

5'-CAGGUCUAAGCCUAGUAUGUCAAUA$^{AC-3'}$ (SEQ ID NO: 2749)
3'-GUCCAGAUUCGGAUCAUACAGUUAU$_{UU-5'}$ (SEQ ID NO: 2365)

MCL1-2575 Target:
5'-CAGGTCTAAGCCTAGTATGTCAATAAA-3' (SEQ ID NO: 2461)

5'-GCCUAGUAUGUCAAUAAAGCAAAUA$^{AC-3'}$ (SEQ ID NO: 2750)
3'-CGGAUCAUACAGUUAUUUCGUUUAU$_{GA-5'}$ (SEQ ID NO: 2366)

MCL1-2584 Target:
5'-GCCTAGTATGTCAATAAAGCAAATACT-3' (SEQ ID NO: 2462)

5'-AUGUCAAUAAAGCAAAUACUUACUG$^{CC-3'}$ (SEQ ID NO: 2751)
3'-UACAGUUAUUUCGUUUAUGAAUGAC$_{AA-5'}$ (SEQ ID NO: 2367)

MCL1-2591 Target:
5'-ATGTCAATAAAGCAAATACTTACTGTT-3' (SEQ ID NO: 2463)

5'-GUCAAUAAAGCAAAUACUUACUGUU$^{CC-3'}$ (SEQ ID NO: 2752)
3'-CAGUUAUUUCGUUUAUGAAUGACAA$_{AA-5'}$ (SEQ ID NO: 2368)

MCL1-2593 Target:
5'-GTCAATAAAGCAAATACTTACTGTTTT-3' (SEQ ID NO: 2464)

5'-AAUAAAGCAAAUACUUACUGUUUUG$^{CC-3'}$ (SEQ ID NO: 2753)
3'-UUAUUUCGUUUAUGAAUGACAAAAC$_{AA-5'}$ (SEQ ID NO: 2369)

MCL1-2596 Target:
5'-AATAAAGCAAATACTTACTGTTTTGTT-3' (SEQ ID NO: 2465)

5'-UAAAGCAAAUACUUACUGUUUUGUU$^{CA-3'}$ (SEQ ID NO: 2754)
3'-AUUUCGUUUAUGAAUGACAAAACAA$_{AG-5'}$ (SEQ ID NO: 2370)

MCL1-2598 Target:
5'-TAAAGCAAATACTTACTGTTTTGTTTC-3' (SEQ ID NO: 2466)

5'-GCAAAUACUUACUGUUUUGUUUCUA$^{CC-3'}$ (SEQ ID NO: 2755)
3'-CGUUUAUGAAUGACAAAACAAAGAU$_{AA-5'}$ (SEQ ID NO: 2371)

MCL1-2602 Target:
5'-GCAAATACTTACTGTTTTGTTTCTATT-3' (SEQ ID NO: 2467)

5'-AAUACUUACUGUUUUGUUUCUAUUA$^{CC-3'}$ (SEQ ID NO: 2756)
3'-UUAUGAAUGACAAAACAAAGAUAAU$_{UA-5'}$ (SEQ ID NO: 2372)

MCL1-2605 Target:
5'-AATACTTACTGTTTTGTTTCTATTAAT-3' (SEQ ID NO: 2468)

5'-UACUUACUGUUUUGUUUCUAUUAAU$^{AC-3'}$ (SEQ ID NO: 2757)
3'-AUGAAUGACAAAACAAAGAUAAUUA$_{CU-5'}$ (SEQ ID NO: 2373)

MCL1-2607 Target:
5'-TACTTACTGTTTTGTTTCTATTAATGA-3' (SEQ ID NO: 2469)

5'-CUUACUGUUUUGUUUCUAUUAAUGA$^{CC-3'}$ (SEQ ID NO: 2758)
3'-GAAUGACAAAACAAAGAUAAUUACU$_{AA-5'}$ (SEQ ID NO: 2374)

MCL1-2609 Target:
5'-CTTACTGTTTTGTTTCTATTAATGATT-3' (SEQ ID NO: 2470)

5'-CUGUUUUGUUUCUAUUAAUGAUUCC$^{AC-3'}$ (SEQ ID NO: 2759)
3'-GACAAAACAAAGAUAAUUACUAAGG$_{GU-5'}$ (SEQ ID NO: 2375)

MCL1-2613 Target:
5'-CTGTTTTGTTTCTATTAATGATTCCCA-3' (SEQ ID NO: 2471)

5'-UAUUAAUGAUUCCCAAACCUUGUUG$^{AC-3'}$ (SEQ ID NO: 2760)
3'-AUAAUUACUAAGGGUUUGGAACAAC$_{GU-5'}$ (SEQ ID NO: 2376)

MCL1-2625 Target:
5'-TATTAATGATTCCCAAACCTTGTTGCA-3' (SEQ ID NO: 2472)

5'-CCCAAACCUUGUUGCAAGUUUUUGC$^{CC-3'}$ (SEQ ID NO: 2761)
3'-GGGUUUGGAACAACGUUCAAAAACG$_{UA-5'}$ (SEQ ID NO: 2377)

MCL1-2636 Target:
5'-CCCAAACCTTGTTGCAAGTTTTTGCAT-3' (SEQ ID NO: 2473)

5'-UGGAUUUCAGUCUUGAUGUUUGUUC$^{CC-3'}$ (SEQ ID NO: 2762)
3'-ACCUAAAGUCAGAACUACAAACAAG$_{AU-5'}$ (SEQ ID NO: 2378)

MCL1-2672 Target:
5'-TGGATTTCAGTCTTGATGTTTGTTCTA-3' (SEQ ID NO: 2474)

5'-CAGUCUUGAUGUUUGUUCUAUCAGA$^{AC-3'}$ (SEQ ID NO: 2763)
3'-GUCAGAACUACAAACAAGAUAGUCU$_{GA-5'}$ (SEQ ID NO: 2379)

MCL1-2679 Target:
5'-CAGTCTTGATGTTTGTTCTATCAGACT-3' (SEQ ID NO: 2475)

5'-CCCUGCCAUCCCUGAACUCUUUCUA$^{AA-3'}$ (SEQ ID NO: 2764)
3'-GGGACGGUAGGGACUUGAGAAAGAU$_{CG-5'}$ (SEQ ID NO: 2380)

MCL1-2790 Target:
5'-CCCTGCCATCCCTGAACTCTTTCTAGC-3' (SEQ ID NO: 2476)

5'-CCCUGAACUCUUUCUAGCCCUUUUA$^{AC-3'}$ (SEQ ID NO: 2765)
3'-GGGACUUGAGAAAGAUCGGGAAAAU$_{CU-5'}$ (SEQ ID NO: 2381)

MCL1-2799 Target:
5'-CCCTGAACTCTTTCTAGCCCTTTTAGA-3' (SEQ ID NO: 2477)

5'-CUGAACUCUUUCUAGCCCUUUUAGA$^{CC-3'}$ (SEQ ID NO: 2766)
3'-GACUUGAGAAAGAUCGGGAAAAUCU$_{AA-5'}$ (SEQ ID NO: 2382)

MCL1-2801 Target:
5'-CTGAACTCTTTCTAGCCCTTTTAGATT-3' (SEQ ID NO: 2478)

5'-UUGAUCCUGUUAGCAGGUGGUAAUA$^{AA-3'}$ (SEQ ID NO: 2767)
3'-AACUAGGACAAUCGUCCACCAUUAU$_{GG-5'}$ (SEQ ID NO: 2383)

MCL1-2911 Target:
5'-TTGATCCTGTTAGCAGGTGGTAATACC-3' (SEQ ID NO: 2479)

5'-UGGACUGGUAUCUUUUCAACUAUUG$^{CC-3'}$ (SEQ ID NO: 2768)
3'-ACCUGACCAUAGAAAAGUUGAUAAC$_{AA-5'}$ (SEQ ID NO: 2384)

TABLE 7-continued

Selected Human Anti-MCL1 "Blunt/Fray" DsiRNAs

MCL1-2992 Target:
5'-TGGACTGGTATCTTTTCAACTATTGTT-3' (SEQ ID NO: 2480)

5'-GAAAGAACAUUUUAUGAGGCUUUCU$A^{AC-3'}$ (SEQ ID NO: 2769)
3'-CUUUCUUGUAAAAUACUCCGAAAGA$G_{A-5'}$ (SEQ ID NO: 2385)

MCL1-3072 Target:
5'-GAAAGAACATTTTATGAGGCTTTCTCT-3' (SEQ ID NO: 2481)

5'-AAGAACAUUUUAUGAGGCUUUCUCU$^{CC-3'}$ (SEQ ID NO: 2770)
3'-UUCUUGUAAAAUACUCCGAAAGAGA$_{U-5'}$ (SEQ ID NO: 2386)

MCL1-3074 Target:
5'-AAGAACATTTTATGAGGCTTTCTCTAA-3' (SEQ ID NO: 2482)

5'-UUAGUCUGUGGACUCCAUUUAAAAA$^{CC-3'}$ (SEQ ID NO: 2771)
3'-AAUCAGACACCUGAGGUAAAUUUUU$_{AU-5'}$ (SEQ ID NO: 2387)

MCL1-3252 Target:
5'-TTAGTCTGTGGACTCCATTTAAAAATA-3' (SEQ ID NO: 2483)

5'-UUCAUUAGGUAUGACUGUGGAAAUA$^{AC-3'}$ (SEQ ID NO: 2772)
3'-AAGUAAUCCAUACUGACACCUUUAU$_{G-5'}$ (SEQ ID NO: 2388)

MCL1-3563 Target:
5'-TTCATTAGGTATGACTGTGGAAATACA-3' (SEQ ID NO: 2484)

5'-CAGACAAGGAUCUUAGUUGAUAUUU$^{CA-3'}$ (SEQ ID NO: 2773)
3'-GUCUGUUCCUAGAAUCAACUAUAAA$_{AC-5'}$ (SEQ ID NO: 2389)

MCL1-3588 Target:
5'-CAGACAAGGATCTTAGTTGATATTTG-3' (SEQ ID NO: 2485)

5'-GUGACUACUUUUUGACUUCUGUUUG$^{CA-3'}$ (SEQ ID NO: 2774)
3'-CACUGAUGAAAAACUGAAGACAAAC$_{AG-5'}$ (SEQ ID NO: 2390)

MCL1-3789 Target:
5'-GTGACTACTTTTTGACTTCTGTTTGTC-3' (SEQ ID NO: 2486)

5'-UUCUGUUUUUCCUGAGAAAAAAAAA$^{CC-3'}$ (SEQ ID NO: 2775)
3'-AAGACAAAAAGGACUCUUUUUUUUU$_{AU-5'}$ (SEQ ID NO: 2391)

MCL1-3989 Target:
5'-TTCTGTTTTTCCTGAGAAAAAAAAATA-3' (SEQ ID NO: 2487)

5'-CUGUUUUUCCUGAGAAAAAAAAUA$^{CC-3'}$ (SEQ ID NO: 2776)
3'-GACAAAAAGGACUCUUUUUUUUUAU$_{U-5'}$ (SEQ ID NO: 2392)

MCL1-3991 Target:
5'-CTGTTTTTCCTGAGAAAAAAAATAAA-3' (SEQ ID NO: 2488)

5'-UUCCUGAGAAAAAAAAUAAAUCUU$^{CC-3'}$ (SEQ ID NO: 2777)
3'-AAGGACUCUUUUUUUUAUUUAGAA$_{A-5'}$ (SEQ ID NO: 2393)

MCL1-3997 Target:
5'-TTCCTGAGAAAAAAAATAAATCTTTT-3' (SEQ ID NO: 2489)

5'-CUGAGAAAAAAAAUAAAUCUUUUA$^{CC-3'}$ (SEQ ID NO: 2778)
3'-GACUCUUUUUUUUAUUUAGAAAAU$_{A-5'}$ (SEQ ID NO: 2394)

MCL1-4000 Target:
5'-CTGAGAAAAAAAATAAATCTTTTATT-3' (SEQ ID NO: 2490)

5'-GAGAAAAAAAAUAAAUCUUUUAUU$^{AC-3'}$ (SEQ ID NO: 2779)
3'-CUCUUUUUUUUAUUUAGAAAAUAA$_{GU-5'}$ (SEQ ID NO: 2395)

MCL1-4002 Target:
5'-GAGAAAAAAAATAAATCTTTTATTCA-3' (SEQ ID NO: 2491)

5'-AAAAAAUAAAUCUUUUAUUCAAAAA$^{CC-3'}$ (SEQ ID NO: 2780)
3'-UUUUUUAUUUAGAAAAUAAGUUUUU$_{U-5'}$ (SEQ ID NO: 2396)

MCL1-4008 Target:
5'-AAAAAATAAATCTTTTATTCAAAAAA-3' (SEQ ID NO: 2492)

TABLE 8

Selected Mouse Anti-MCL1 "Blunt/Fray" DsiRNAs

5'-AGGGAACGGCCUUCCUCACUCCUGA$A^{C-3'}$ (SEQ ID NO: 1776)
3'-UCCCUUGCCGGAAGGAGUGAGGACU$G_{A-5'}$ (SEQ ID NO: 516)

MCL1-m69 Target:
5'-AGGGAACGGCCTTCCTCACTCCTGACT-3' (SEQ ID NO: 831)

5'-CUGCGGAGAAACGCGGUCAUCGGCU$C^{A-3'}$ (SEQ ID NO: 1777)
3'-GACGCCUCUUUGCGCCAGUAGCCGA$A_{C-5'}$ (SEQ ID NO: 517)

MCL1-m172 Target:
5'-CTGCGGAGAAACGCGGTCATCGGCTTG-3' (SEQ ID NO: 832)

5'-CCGGAGGAGGAACUGGACGGCUGCG$C^{A-3'}$ (SEQ ID NO: 1778)
3'-GGCCUCCUCCUUGACCUGCCGACGC$U_{C-5'}$ (SEQ ID NO: 518)

MCL1-m469 Target:
5'-CCGGAGGAGGAACTGGACGGCTGCGAG-3' (SEQ ID NO: 833)

5'-CGAGGAGGAAGAGGACGACCUAUAC$A^{A-3'}$ (SEQ ID NO: 1779)
3'-GCUCCUCCUUCUCCUGCUGGAUAUG$G_{C-5'}$ (SEQ ID NO: 519)

MCL1-m606 Target:
5'-CGAGGAGGAAGAGGACGACCTATACCG-3' (SEQ ID NO: 834)

5'-GAGGAGGAAGAGGACGACCUAUACC$A^{A-3'}$ (SEQ ID NO: 1780)
3'-CUCCUCCUUCUCCUGCUGGAUAUGG$G_{G-5'}$ (SEQ ID NO: 520)

MCL1-m607 Target:
5'-GAGGAGGAAGAGGACGACCTATACCGC-3' (SEQ ID NO: 835)

5'-AGGAGGAAGAGGACGACCUAUACCG$A^{A-3'}$ (SEQ ID NO: 1781)
3'-UCCUCCUUCUCCUGCUGGAUAUGGC$G_{G-5'}$ (SEQ ID NO: 521)

MCL1-m608 Target:
5'-AGGAGGAAGAGGACGACCTATACCGCC-3' (SEQ ID NO: 836)

5'-GAGGAAGAGGACGACCUAUACCGCC$C^{A-3'}$ (SEQ ID NO: 1782)
3'-CUCCUUCUCCUGCUGGAUAUGGCGG$U_{C-5'}$ (SEQ ID NO: 522)

MCL1-m610 Target:
5'-GAGGAAGAGGACGACCTATACCGCCAG-3' (SEQ ID NO: 837)

5'-CAGGAUUGUGACUCUUAUUUCUUUC$A^{A-3'}$ (SEQ ID NO: 1783)
3'-GUCCUAACACUGAGAAUAAAGAAAG$_{C C-5'}$ (SEQ ID NO: 523)

TABLE 8-continued

Selected Mouse Anti-MCL1 "Blunt/Fray" DsiRNAs

MCL1-m891 Target:
5'-CAGGATTGTGACTCTTATTTCTTTCGG-3' (SEQ ID NO: 838)

5'-UGUGGCCAAACACUUAAAGAGCGUA$^{CC-3'}$ (SEQ ID NO: 1784)
3'-ACACCGGUUUGUGAAUUUCUCGCAU$_{U}{}_{U-5'}$ (SEQ ID NO: 524)

MCL1-m924 Target:
5'-TGTGGCCAAACACTTAAAGAGCGTAAA-3' (SEQ ID NO: 839)

5'-GUGGCCAAACACUUAAAGAGCGUAA$^{CA-3'}$ (SEQ ID NO: 1785)
3'-CACCGGUUUGUGAAUUUCUCGCAUU$_{U}{}_{G-5'}$ (SEQ ID NO: 525)

MCL1-m925 Target:
5'-GTGGCCAAACACTTAAAGAGCGTAAAC-3' (SEQ ID NO: 840)

5'-UGGCCAAACACUUAAAGAGCGUAAA$^{AA-3'}$ (SEQ ID NO: 1786)
3'-ACCGGUUUGUGAAUUUCUCGCAUUU$_{G}{}_{G-5'}$ (SEQ ID NO: 526)

MCL1-m926 Target:
5'-TGGCCAAACACTTAAAGAGCGTAAACC-3' (SEQ ID NO: 841)

5'-AAAGAGCGUAAACCAAGAAAGCUUC$^{CC-3'}$ (SEQ ID NO: 1787)
3'-UUUCUCGCAUUUGGUUCUUUCGAAG$_{U}{}_{A-5'}$ (SEQ ID NO: 527)

MCL1-m939 Target:
5'-AAAGAGCGTAAACCAAGAAAGCTTCAT-3' (SEQ ID NO: 842)

5'-CGAACCAUUAGCAGAAACUAUCACA$^{AC-3'}$ (SEQ ID NO: 1788)
3'-GCUUGGUAAUCGUCUUUGAUAGUGU$_{C}{}_{U-5'}$ (SEQ ID NO: 528)

MCL1-m966 Target:
5'-CGAACCATTAGCAGAAACTATCACAGA-3' (SEQ ID NO: 843)

5'-UUAGCAGAAACUAUCACAGAUGUUC$^{CC-3'}$ (SEQ ID NO: 1789)
3'-AAUCGUCUUUGAUAGUGUCUACAAG$_{A}{}_{A-5'}$ (SEQ ID NO: 529)

MCL1-m973 Target:
5'-TTAGCAGAAACTATCACAGATGTTCTT-3' (SEQ ID NO: 844)

5'-ACGGGACUGGCUUGUCAAACAAAGA$^{AA-3'}$ (SEQ ID NO: 1790)
3'-UGCCCUGACCGAACAGUUUGUUUCU$_{C}{}_{C-5'}$ (SEQ ID NO: 530)

MCL1-m1011 Target:
5'-ACGGGACTGGCTTGTCAAACAAAGAGG-3' (SEQ ID NO: 845)

5'-CGGGACUGGCUUGUCAAACAAAGAG$^{AA-3'}$ (SEQ ID NO: 1791)
3'-GCCCUGACCGAACAGUUUGUUUCUC$_{C}{}_{G-5'}$ (SEQ ID NO: 531)

MCL1-m1012 Target:
5'-CGGGACTGGCTTGTCAAACAAAGAGGC-3' (SEQ ID NO: 846)

5'-UUGUGGAGUUCUUCCACGUACAGGA$^{AA-3'}$ (SEQ ID NO: 1792)
3'-AACACCUCAAGAAGGUGCAUGUCCU$_{G}{}_{G-5'}$ (SEQ ID NO: 532)

MCL1-m1049 Target:
5'-TTGTGGAGTTCTTCCACGTACAGGACC-3' (SEQ ID NO: 847)

5'-GGAGUUCUUCCACGUACAGGACCUA$^{AC-3'}$ (SEQ ID NO: 1793)
3'-CCUCAAGAAGGUGCAUGUCCUGGAU$_{C}{}_{U-5'}$ (SEQ ID NO: 533)

MCL1-m1053 Target:
5'-GGAGTTCTTCCACGTACAGGACCTAGA-3' (SEQ ID NO: 848)

5'-UUCCACGUACAGGACCUAGAAGGCG$^{AA-3'}$ (SEQ ID NO: 1794)
3'-AAGGUGCAUGUCCUGGAUCUUCCGC$_{C}{}_{G-5'}$ (SEQ ID NO: 534)

MCL1-m1060 Target:
5'-TTCCACGTACAGGACCTAGAAGGCGGC-3' (SEQ ID NO: 849)

5'-CUGGUCUGGCAUAUCUAAUAAGAUA$^{AA-3'}$ (SEQ ID NO: 1795)
3'-GACCAGACCGUAUAGAUUAUUCUAU$_{C}{}_{G-5'}$ (SEQ ID NO: 535)

MCL1-m1133 Target:
5'-CTGGTCTGGCATATCTAATAAGATAGC-3' (SEQ ID NO: 850)

5'-AGCCACCAAACUACAUGCAUCUGUG$^{CC-3'}$ (SEQ ID NO: 1796)
3'-UCGGUGGUUUGAUGUACGUAGACAC$_{U}{}_{U-5'}$ (SEQ ID NO: 536)

MCL1-m1193 Target:
5'-AGCCACCAAACTACATGCATCTGTGAA-3' (SEQ ID NO: 851)

5'-CAUGUGUAUUUAUGAAGGUGGACUU$^{AC-3'}$ (SEQ ID NO: 1797)
3'-GUACACAUAAAUACUUCCACCUGAA$_{C}{}_{U-5'}$ (SEQ ID NO: 537)

MCL1-m1222 Target:
5'-CATGTGTATTTATGAAGGTGGACTTGA-3' (SEQ ID NO: 852)

5'-UGUGUAUUUAUGAAGGUGGACUUGA$^{CA-3'}$ (SEQ ID NO: 1798)
3'-ACACAUAAAUACUUCCACCUGAACU$_{U}{}_{C-5'}$ (SEQ ID NO: 538)

MCL1-m1224 Target:
5'-TGTGTATTTATGAAGGTGGACTTGAAG-3' (SEQ ID NO: 853)

5'-GUAUUUAUGAAGGUGGACUUGAAGC$^{CA-3'}$ (SEQ ID NO: 1799)
3'-CAUAAAUACUUCCACCUGAACUUCG$_{A}{}_{C-5'}$ (SEQ ID NO: 539)

MCL1-m1227 Target:
5'-GTATTTATGAAGGTGGACTTGAAGCTG-3' (SEQ ID NO: 854)

5'-GUCCAGUUCUACUGUAGCAACAUAG$^{AC-3'}$ (SEQ ID NO: 1800)
3'-CAGGUCAAGAUGACAUCGUUGUAUC$_{G}{}_{U-5'}$ (SEQ ID NO: 540)

MCL1-m1269 Target:
5'-GTCCAGTTCTACTGTAGCAACATAGCA-3' (SEQ ID NO: 855)

5'-CCCUGGAAGAGUCACUGUCUGAAUG$^{CC-3'}$ (SEQ ID NO: 1801)
3'-GGGACCUUCUCAGUGACAGACUUAC$_{U}{}_{U-5'}$ (SEQ ID NO: 541)

MCL1-m1355 Target:
5'-CCCTGGAAGAGTCACTGTCTGAATGAA-3' (SEQ ID NO: 856)

5'-CCUGGAAGAGUCACUGUCUGAAUGA$^{CA-3'}$ (SEQ ID NO: 1802)
3'-GGACCUUCUCAGUGACAGACUUACU$_{U}{}_{C-5'}$ (SEQ ID NO: 542)

MCL1-m1356 Target:
5'-CCTGGAAGAGTCACTGTCTGAATGAAG-3' (SEQ ID NO: 857)

5'-CUGGAAGAGUCACUGUCUGAAUGAA$^{AA-3'}$ (SEQ ID NO: 1803)
3'-GACCUUCUCAGUGACAGACUUACUU$_{C}{}_{G-5'}$ (SEQ ID NO: 543)

TABLE 8-continued

Selected Mouse Anti-MCL1 "Blunt/Fray" DsiRNAs

MCL1-m1357 Target:
5'-CTGGAAGAGTCACTGTCTGAATGAAGC-3' (SEQ ID NO: 858)

5'-CACUGUCUGAAUGAAGCAAAGUUCC$^{A}$$^{C-3'}$ (SEQ ID NO: 1804)
3'-GUGACAGACUUACUUCGUUUCAAGG$_{G}$$_{A-5'}$ (SEQ ID NO: 544)

MCL1-m1367 Target:
5'-CACTGTCTGAATGAAGCAAAGTTCCCT-3' (SEQ ID NO: 859)

5'-UUCCCUCUCAGCAAACACUGAGAGG$^{A}$$^{C-3'}$ (SEQ ID NO: 1805)
3'-AAGGGAGAGUCGUUUGUGACUCUCC$_{G}$$_{A-5'}$ (SEQ ID NO: 545)

MCL1-m1388 Target:
5'-TTCCCTCTCAGCAAACACTGAGAGGCC-3' (SEQ ID NO: 860)

5'-UCCCUCUCAGCAAACACUGAGAGGC$^{A}$$^{C-3'}$ (SEQ ID NO: 1806)
3'-AGGGAGAGUCGUUUGUGACUCUCCG$_{G}$$_{U-5'}$ (SEQ ID NO: 546)

MCL1-m1389 Target:
5'-TCCCTCTCAGCAAACACTGAGAGGCCA-3' (SEQ ID NO: 861)

5'-UCAGCAAACACUGAGAGGCCAUGGA$^{A}$$^{C-3'}$ (SEQ ID NO: 1807)
3'-AGUCGUUUGUGACUCUCCGGUACCU$_{C}$$_{U-5'}$ (SEQ ID NO: 547)

MCL1-m1395 Target:
5'-TCAGCAAACACTGAGAGGCCATGGAGA-3' (SEQ ID NO: 862)

5'-AACACUGAGAGGCCAUGGAGAAGGA$^{A}$$^{C-3'}$ (SEQ ID NO: 1808)
3'-UUGUGACUCUCCGGUACCUCUUCCU$_{G}$$_{A-5'}$ (SEQ ID NO: 548)

MCL1-m1401 Target:
5'-AACACTGAGAGGCCATGGAGAAGGACT-3' (SEQ ID NO: 863)

5'-GAGGCCAUGGAGAAGGACUUCUAGA$^{C}$$^{C-3'}$ (SEQ ID NO: 1809)
3'-CUCCGGUACCUCUUCCUGAAGAUCU$_{U}$$_{A-5'}$ (SEQ ID NO: 549)

MCL1-m1409 Target:
5'-GAGGCCATGGAGAAGGACTTCTAGAAT-3' (SEQ ID NO: 864)

5'-AGGCCAUGGAGAAGGACUUCUAGAA$^{C}$$^{A-3'}$ (SEQ ID NO: 1810)
3'-UCCGGUACCUCUUCCUGAAGAUCUU$_{A}$$_{C-5'}$ (SEQ ID NO: 550)

MCL1-m1410 Target:
5'-AGGCCATGGAGAAGGACTTCTAGAATG-3' (SEQ ID NO: 865)

5'-UGGAGAAGGACUUCUAGAAUGAAUG$^{C}$$^{C-3'}$ (SEQ ID NO: 1811)
3'-ACCUCUUCCUGAAGAUCUUACUUAC$_{U}$$_{U-5'}$ (SEQ ID NO: 551)

MCL1-m1416 Target:
5'-TGGAGAAGGACTTCTAGAATGAATGAA-3' (SEQ ID NO: 866)

5'-GAAGGACUUCUAGAAUGAAUGAAAG$^{A}$$^{A-3'}$ (SEQ ID NO: 1812)
3'-CUUCCUGAAGAUCUUACUUACUUUC$_{C}$$_{C-5'}$ (SEQ ID NO: 552)

MCL1-m1420 Target:
5'-GAAGGACTTCTAGAATGAATGAAAGGG-3' (SEQ ID NO: 867)

5'-GUGGAUGGAAAGGUUUGAUUUCCUA$^{C}$$^{A-3'}$ (SEQ ID NO: 1813)
3'-CACCUACCUUUCCAAACUAAAGGAU$_{A}$$_{G-5'}$ (SEQ ID NO: 553)

TABLE 8-continued

Selected Mouse Anti-MCL1 "Blunt/Fray" DsiRNAs

MCL1-m1447 Target:
5'-GTGGATGGAAAGGTTTGATTTCCTATC-3' (SEQ ID NO: 868)

5'-CCAGUCAUCAGGCUAGUCACAAAGC$^{C}$$^{A-3'}$ (SEQ ID NO: 1814)
3'-GGUCAGUAGUCCGAUCAGUGUUUCG$_{A}$$_{G-5'}$ (SEQ ID NO: 554)

MCL1-m1491 Target:
5'-CCAGTCATCAGGCTAGTCACAAAGCTC-3' (SEQ ID NO: 869)

5'-CAGUCAUCAGGCUAGUCACAAAGCU$^{A}$$^{C-3'}$ (SEQ ID NO: 1815)
3'-GUCAGUAGUCCGAUCAGUGUUUCGA$_{G}$$_{U-5'}$ (SEQ ID NO: 555)

MCL1-m1492 Target:
5'-CAGTCATCAGGCTAGTCACAAAGCTCA-3' (SEQ ID NO: 870)

5'-AGGCUAGUCACAAAGCUCAAUAAAU$^{C}$$^{C-3'}$ (SEQ ID NO: 1816)
3'-UCCGAUCAGUGUUUCGAGUUAUUUA$_{U}$$_{A-5'}$ (SEQ ID NO: 556)

MCL1-m1500 Target:
5'-AGGCTAGTCACAAAGCTCAATAAATAT-3' (SEQ ID NO: 871)

5'-AAGCCCUAAUUAACAACGUUGGUGA$^{A}$$^{C-3'}$ (SEQ ID NO: 1817)
3'-UUCGGGAUUAAUUGUUGCAACCACU$_{G}$$_{A-5'}$ (SEQ ID NO: 557)

MCL1-m1556 Target:
5'-AAGCCCTAATTAACAACGTTGGTGACT-3' (SEQ ID NO: 872)

5'-AACCUACAAGUCACCAAACGAUGAC$^{C}$$^{C-3'}$ (SEQ ID NO: 1818)
3'-UUGGAUGUUCAGUGGUUUGCUACUG$_{A}$$_{U-5'}$ (SEQ ID NO: 558)

MCL1-m1601 Target:
5'-AACCTACAAGTCACCAAACGATGACTA-3' (SEQ ID NO: 873)

5'-ACCUACAAGUCACCAAACGAUGACU$^{C}$$^{A-3'}$ (SEQ ID NO: 1819)
3'-UGGAUGUUCAGUGGUUUGCUACUGA$_{U}$$_{C-5'}$ (SEQ ID NO: 559)

MCL1-m1602 Target:
5'-ACCTACAAGTCACCAAACGATGACTAG-3' (SEQ ID NO: 874)

5'-AGUCACCAAACGAUGACUAGAAGCU$^{A}$$^{A-3'}$ (SEQ ID NO: 1820)
3'-UCAGUGGUUUGCUACUGAUCUUCGA$_{C}$$_{G-5'}$ (SEQ ID NO: 560)

MCL1-m1609 Target:
5'-AGTCACCAAACGATGACTAGAAGCTGC-3' (SEQ ID NO: 875)

5'-GUCACCAAACGAUGACUAGAAGCUG$^{A}$$^{C-3'}$ (SEQ ID NO: 1821)
3'-CAGUGGUUUGCUACUGAUCUUCGAC$_{G}$$_{U-5'}$ (SEQ ID NO: 561)

MCL1-m1610 Target:
5'-GTCACCAAACGATGACTAGAAGCTGCA-3' (SEQ ID NO: 876)

5'-UCACCAAACGAUGACUAGAAGCUGC$^{C}$$^{A-3'}$ (SEQ ID NO: 1822)
3'-AGUGGUUUGCUACUGAUCUUCGACG$_{U}$$_{C-5'}$ (SEQ ID NO: 562)

MCL1-m1611 Target:
5'-TCACCAAACGATGACTAGAAGCTGCAG-3' (SEQ ID NO: 877)

5'-CACCAAACGAUGACUAGAAGCUGCA$^{A}$$^{C-3'}$ (SEQ ID NO: 1823)
3'-GUGGUUUGCUACUGAUCUUCGACGU$_{C}$$_{A-5'}$ (SEQ ID NO: 563)

TABLE 8-continued

Selected Mouse Anti-MCL1 "Blunt/Fray" DsiRNAs

MCL1-m1612 Target:
5'-CACCAAACGATGACTAGAAGCTGCAGT-3' (SEQ ID NO: 878)

5'-CAGGAAUGUGAAGGGAGGCCUCUGA$^{AA-3'}$ (SEQ ID NO: 1824)
3'-GUCCUUACACUUCCCUCCGGAGACU$_{CG-5'}$ (SEQ ID NO: 564)

MCL1-m1645 Target:
5'-CAGGAATGTGAAGGGAGGCCTCTGAGC-3' (SEQ ID NO: 879)

5'-UGUGCUUGACAAAGUCCCAAGUGCU$^{AC-3'}$ (SEQ ID NO: 1825)
3'-ACACGAACUGUUUCAGGGUUCACGA$_{GU-5'}$ (SEQ ID NO: 565)

MCL1-m1681 Target:
5'-TGTGCTTGACAAAGTCCCAAGTGCTCA-3' (SEQ ID NO: 880)

5'-GUGCUUGACAAAGUCCCAAGUGCUC$^{CCA-3'}$ (SEQ ID NO: 1826)
3'-CACGAACUGUUUCAGGGUUCACGAG$_{UC-5'}$ (SEQ ID NO: 566)

MCL1-m1682 Target:
5'-GTGCTTGACAAAGTCCCAAGTGCTCAG-3' (SEQ ID NO: 881)

5'-UUGACAAAGUCCCAAGUGCUCAGGA$^{AC-3'}$ (SEQ ID NO: 1827)
3'-AACUGUUUCAGGGUUCACGAGUCCU$_{GA-5'}$ (SEQ ID NO: 567)

MCL1-m1686 Target:
5'-TTGACAAAGTCCCAAGTGCTCAGGACT-3' (SEQ ID NO: 882)

5'-AGCCCUGUCUACUUUGGCUUGGUUU$^{AA-3'}$ (SEQ ID NO: 1828)
3'-UCGGGACAGAUGAAACCGAACCAAA$_{CC-5'}$ (SEQ ID NO: 568)

MCL1-m1716 Target:
5'-AGCCCTGTCTACTTTGGCTTGGTTTGG-3' (SEQ ID NO: 883)

5'-UUCUUAAGUUUAUUAGCCUAGUGAU$^{AA-3'}$ (SEQ ID NO: 1829)
3'-AAGAAUUCAAAUAAUCGGAUCACUA$_{CC-5'}$ (SEQ ID NO: 569)

MCL1-m1747 Target:
5'-TTCTTAAGTTTATTAGCCTAGTGATGG-3' (SEQ ID NO: 884)

5'-AAAGUACUUGACUUAAGGUUCACUA$^{CC-3'}$ (SEQ ID NO: 1830)
3'-UUUCAUGAACUGAAUUCCAAGUGAU$_{UA-5'}$ (SEQ ID NO: 570)

MCL1-m1778 Target:
5'-AAAGTACTTGACTTAAGGTTCACTAAT-3' (SEQ ID NO: 885)

5'-GAACAUAAGAGGGAAGUCUUGGAUU$^{CC-3'}$ (SEQ ID NO: 1831)
3'-CUUGUAUUCUCCCUUCAGAACCUAA$_{AU-5'}$ (SEQ ID NO: 571)

MCL1-m1902 Target:
5'-GAACATAAGAGGGAAGTCTTGGATTTA-3' (SEQ ID NO: 886)

5'-CAGCUUCUCUAGUUAGAAAUGUAUU$^{CA-3'}$ (SEQ ID NO: 1832)
3'-GUCGAAGAGAUCAAUCUUUACAUAA$_{AG-5'}$ (SEQ ID NO: 572)

MCL1-m1957 Target:
5'-CAGCTTCTCTAGTTAGAAATGTATTTC-3' (SEQ ID NO: 887)

5'-UGUCAUCCGUUCUAGUGUAUAUGCA$^{AC-3'}$ (SEQ ID NO: 1833)
3'-ACAGUAGGCAAGAUCACAUAUACGU$_{CU-5'}$ (SEQ ID NO: 573)

MCL1-m2003 Target:
5'-TGTCATCCGTTCTAGTGTATATGCAGA-3' (SEQ ID NO: 888)

5'-UGUGUGUGGACUGGUUAUAGAUUUA$^{CC-3'}$ (SEQ ID NO: 1834)
3'-ACACACACCUGACCAAUAUCUAAAU$_{AU-5'}$ (SEQ ID NO: 574)

MCL1-m2038 Target:
5'-TGTGTGTGGACTGGTTATAGATTTATA-3' (SEQ ID NO: 889)

5'-UAACUAUGCAGGGUUAAUUAUCCAA$^{CA-3'}$ (SEQ ID NO: 1835)
3'-AUUGAUACGUCCCAAUUAAUAGGUU$_{AG-5'}$ (SEQ ID NO: 575)

MCL1-m2063 Target:
5'-TAACTATGCAGGGTTAATTATCCAATC-3' (SEQ ID NO: 890)

5'-AUCACAGGUAGAUAGAUGUAAGACA$^{CC-3'}$ (SEQ ID NO: 1836)
3'-UAGUGUCCAUCUAUCUACAUUCUGU$_{AA-5'}$ (SEQ ID NO: 576)

MCL1-m2110 Target:
5'-ATCACAGGTAGATAGATGTAAGACATT-3' (SEQ ID NO: 891)

5'-AGGUAGAUAGAUGUAAGACAUUUGA$^{CA-3'}$ (SEQ ID NO: 1837)
3'-UCCAUCUAUCUACAUUCUGUAAACU$_{AG-5'}$ (SEQ ID NO: 577)

MCL1-m2115 Target:
5'-AGGTAGATAGATGTAAGACATTTGATC-3' (SEQ ID NO: 892)

5'-GUAAAUGGUAAAGCAGGCUAGAGUC$^{CC-3'}$ (SEQ ID NO: 1838)
3'-CAUUUACCAUUUCGUCCGAUCUCAG$_{AA-5'}$ (SEQ ID NO: 578)

MCL1-m2162 Target:
5'-GTAAATGGTAAAGCAGGCTAGAGTCTT-3' (SEQ ID NO: 893)

5'-AUGGUGCUAUUCACUGGGUUUACUU$^{AC-3'}$ (SEQ ID NO: 1839)
3'-UACCACGAUAAGUGACCCAAAUGAA$_{CA-5'}$ (SEQ ID NO: 579)

MCL1-m2193 Target:
5'-ATGGTGCTATTCACTGGGTTTACTTGT-3' (SEQ ID NO: 894)

5'-UUUCUUGUCUACUAAGGAUUGCCAA$^{AA-3'}$ (SEQ ID NO: 1840)
3'-AAAGAACAGAUGAUUCCUAACGGUU$_{CG-5'}$ (SEQ ID NO: 580)

MCL1-m2262 Target:
5'-TTTCTTGTCTACTAAGGATTGCCAAGC-3' (SEQ ID NO: 895)

5'-UGGUCUCUAGGUGUAGCCUUUACUU$^{AA-3'}$ (SEQ ID NO: 1841)
3'-ACCAGAGAUCCACAUCGGAAAUGAA$_{GG-5'}$ (SEQ ID NO: 581)

MCL1-m2309 Target:
5'-TGGTCTCTAGGTGTAGCCTTTACTTCC-3' (SEQ ID NO: 896)

5'-CCCUAUAHAHUCHUCUACACUUCCU$^{AA-3'}$ (SEQ ID NO: 1842)
3'-GGGAUAUCUCAGCAGAUGUGAAGGA$_{GG-5'}$ (SEQ ID NO: 582)

MCL1-m2366 Target:
5'-CCCTATAGAGTCGTCTACACTTCCTCC-3' (SEQ ID NO: 897)

5'-GUCGUCUACACUUCCUCCCUGUGCU$^{AC-3'}$ (SEQ ID NO: 1843)
3'-CAGCAGAUGUGAAGGAGGGACACGA$_{GA-5'}$ (SEQ ID NO: 583)

TABLE 8-continued

Selected Mouse Anti-MCL1 "Blunt/Fray" DsiRNAs

MCL1-m2375 Target:
5'-GTCGTCTACACTTCCTCCCTGTGCTCT-3' (SEQ ID NO: 898)

5'-UAGUUAUCUGCAUUAGAACUCUCAC$^{AA\text{-}3'}$ (SEQ ID NO: 1844)
3'-AUCAAUAGACGUAAUCUUGAGAGUG$_{G\text{-}5'}$ (SEQ ID NO: 584)

MCL1-m2415 Target:
5'-TAGTTATCTGCATTAGAACTCTCACCC-3' (SEQ ID NO: 899)

5'-AUCCUAAUCAGAGUCAGCACAGCUU$^{CA\text{-}3'}$ (SEQ ID NO: 1845)
3'-UAGGAUUAGUCUCAGUCGUGUCGAA$_{AG\text{-}5'}$ (SEQ ID NO: 585)

MCL1-m2482 Target:
5'-ATCCTAATCAGAGTCAGCACAGCTTTC-3' (SEQ ID NO: 900)

5'-ACAGCUUUCCUGUCAGAGGAUAGGA$^{CA\text{-}3'}$ (SEQ ID NO: 1846)
3'-UGUCGAAAGGACAGUCUCCUAUCCU$_{UG\text{-}5'}$ (SEQ ID NO: 586)

MCL1-m2500 Target:
5'-ACAGCTTTCCTGTCAGAGGATAGGAAC-3' (SEQ ID NO: 901)

5'-UUCCUGUCAGAGGAUAGGAACACUU$^{AA\text{-}3'}$ (SEQ ID NO: 1847)
3'-AAGGACAGUCUCCUAUCCUUGUGAA$_{CG\text{-}5'}$ (SEQ ID NO: 587)

MCL1-m2506 Target:
5'-TTCCTGTCAGAGGATAGGAACACTTGC-3' (SEQ ID NO: 902)

5'-CUGUCAGAGGAUAGGAACACUUGCU$^{AC\text{-}3'}$ (SEQ ID NO: 1848)
3'-GACAGUCUCCUAUCCUUGUGAACGA$_{GA\text{-}5'}$ (SEQ ID NO: 588)

MCL1-m2509 Target:
5'-CTGTCAGAGGATAGGAACACTTGCTCT-3' (SEQ ID NO: 903)

5'-UGUCAGAGGAUAGGAACACUUGCUC$^{CC\text{-}3'}$ (SEQ ID NO: 1849)
3'-ACAGUCUCCUAUCCUUGUGAACGAG$_{AA\text{-}5'}$ (SEQ ID NO: 589)

MCL1-m2510 Target:
5'-TGTCAGAGGATAGGAACACTTGCTCTT-3' (SEQ ID NO: 904)

5'-GACCGACAGUGACCAGGGAUUGGCA$^{CC\text{-}3'}$ (SEQ ID NO: 1850)
3'-CUGGCUGUCACUGGUCCCUAACCGU$_{AA\text{-}5'}$ (SEQ ID NO: 590)

MCL1-m2547 Target:
5'-GACCGACAGTGACCAGGGATTGGCATT-3' (SEQ ID NO: 905)

5'-CAUGCUUUCCAUUGUUACUUUGUCU$^{CC\text{-}3'}$ (SEQ ID NO: 1851)
3'-GUACGAAAGGUAACAAUGAAACAGA$_{UA\text{-}5'}$ (SEQ ID NO: 591)

MCL1-m2584 Target:
5'-CATGCTTTCCATTGTTACTTTGTCTAT-3' (SEQ ID NO: 906)

5'-AAGGUUGGAAAUUAUACGUUUAUAC$^{CC\text{-}3'}$ (SEQ ID NO: 1852)
3'-UUCCAACCUUUAAUAUGCAAAUAUG$_{AA\text{-}5'}$ (SEQ ID NO: 592)

MCL1-m2651 Target:
5'-AAGGTTGGAAATTATACGTTTATACTT-3' (SEQ ID NO: 907)

5'-UUAUUAGUUUGCUCCAAGUAUGACU$^{AC\text{-}3'}$ (SEQ ID NO: 1853)
3'-AAUAAUCAAACGAGGUUCAUACUGA$_{CA\text{-}5'}$ (SEQ ID NO: 593)

TABLE 8-continued

Selected Mouse Anti-MCL1 "Blunt/Fray" DsiRNAs

MCL1-m2678 Target:
5'-TTATTAGTTTGCTCCAAGTATGACTGT-3' (SEQ ID NO: 908)

5'-UUCACUUAAGUUUAGAGAAACACUG$^{AA\text{-}3'}$ (SEQ ID NO: 1854)
3'-AAGUGAAUUCAAAUCUCUUUGUGAC$_{CC\text{-}5'}$ (SEQ ID NO: 594)

MCL1-m2706 Target:
5'-TTCACTTAAGTTTAGAGAAACACTGGG-3' (SEQ ID NO: 909)

5'-CCACUGGUAACUGAAGGUAUUUAAG$^{AC\text{-}3'}$ (SEQ ID NO: 1855)
3'-GGUGACCAUUGACUUCCAUAAAUUC$_{GA\text{-}5'}$ (SEQ ID NO: 595)

MCL1-m2758 Target:
5'-CCACTGGTAACTGAAGGTATTTAAGCT-3' (SEQ ID NO: 910)

5'-CAGCCUCAGAAUGUGACCUUUAGUC$^{CC\text{-}3'}$ (SEQ ID NO: 1856)
3'-GUCGGAGUCUUACACUGGAAAUCAG$_{UC\text{-}5'}$ (SEQ ID NO: 596)

MCL1-m2803 Target:
5'-CAGCCTCAGAATGTGACCTTTAGTCAG-3' (SEQ ID NO: 911)

5'-AAUAGGCAGGAAUCAAAUGACUAAG$^{CC\text{-}3'}$ (SEQ ID NO: 1857)
3'-UUAUCCGUCCUUAGUUUACUGAUUC$_{UU\text{-}5'}$ (SEQ ID NO: 597)

MCL1-m2843 Target:
5'-AATAGGCAGGAATCAAATGACTAAGAA-3' (SEQ ID NO: 912)

5'-AUAGGCAGGAAUCAAAUGACUAAGA$^{CC\text{-}3'}$ (SEQ ID NO: 1858)
3'-UAUCCGUCCUUAGUUUACUGAUUCU$_{UA\text{-}5'}$ (SEQ ID NO: 598)

MCL1-m2844 Target:
5'-ATAGGCAGGAATCAAATGACTAAGAAT-3' (SEQ ID NO: 913)

5'-UAGGCAGGAAUCAAAUGACUAAGAA$^{CA\text{-}3'}$ (SEQ ID NO: 1859)
3'-AUCCGUCCUUAGUUUACUGAUUCUU$_{AC\text{-}5'}$ (SEQ ID NO: 599)

MCL1-m2845 Target:
5'-TAGGCAGGAATCAAATGACTAAGAATG-3' (SEQ ID NO: 914)

5'-AGGCAGGAAUCAAAUGACUAAGAAU$^{AC\text{-}3'}$ (SEQ ID NO: 1860)
3'-UCCGUCCUUAGUUUACUGAUUCUUA$_{CA\text{-}5'}$ (SEQ ID NO: 600)

MCL1-m2846 Target:
5'-AGGCAGGAATCAAATGACTAAGAATGT-3' (SEQ ID NO: 915)

5'-GGCAGGAAUCAAAUGACUAAGAAUG$^{CC\text{-}3'}$ (SEQ ID NO: 1861)
3'-CCGUCCUUAGUUUACUGAUUCUUAC$_{AU\text{-}5'}$ (SEQ ID NO: 601)

MCL1-m2847 Target:
5'-GGCAGGAATCAAATGACTAAGAATGTA-3' (SEQ ID NO: 916)

5'-GCAGGAAUCAAAUGACUAAGAAUGU$^{CC\text{-}3'}$ (SEQ ID NO: 1862)
3'-CGUCCUUAGUUUACUGAUUCUUACA$_{UU\text{-}5'}$ (SEQ ID NO: 602)

MCL1-m2848 Target:
5'-GCAGGAATCAAATGACTAAGAATGTAA-3' (SEQ ID NO: 917)

5'-CAGGAAUCAAAUGACUAAGAAUGUA$^{CC\text{-}3'}$ (SEQ ID NO: 1863)
3'-GUCCUUAGUUUACUGAUUCUUACAU$_{UA\text{-}5'}$ (SEQ ID NO: 603)

TABLE 8-continued

Selected Mouse Anti-MCL1 "Blunt/Fray" DsiRNAs

MCL1-m2849 Target:
5'-CAGGAATCAAATGACTAAGAATGTAAT-3' (SEQ ID NO: 918)

5'-AGGAAUCAAAUGACUAAGAAUGUAA$_A$C$^C$-3'  (SEQ ID NO: 1864)
3'-UCCUUAGUUUACUGAUUCUUACAUU$_{A-5'}$U       (SEQ ID NO: 604)

MCL1-m2850 Target:
5'-AGGAATCAAATGACTAAGAATGTAATA-3' (SEQ ID NO: 919)

5'-AUGACUAAGAAUGUAAUAGGGAAGA$_C$A-3'  (SEQ ID NO: 1865)
3'-UACUGAUUCUUACAUUAUCCCUUCU$_{U-5'}$C (SEQ ID NO: 605)

MCL1-m2859 Target:
5'-ATGACTAAGAATGTAATAGGGAAGAAG-3' (SEQ ID NO: 920)

5'-CUGCCAGCUUGGGAGUGAUUUGUAC$_A$C-3'  (SEQ ID NO: 1866)
3'-GACGGUCGAACCCUCACUAAACAUG$_{G-5'}$A (SEQ ID NO: 606)

MCL1-m2894 Target:
5'-CTGCCAGCTTGGGAGTGATTTGTACCT-3' (SEQ ID NO: 921)

5'-AUCCUUGAUCAUAGUUUGCUUAUUU$^C$C-3'  (SEQ ID NO: 1867)
3'-UAGGAACUAGUAUCAAACGAAUAAA$_{A-5'}$U (SEQ ID NO: 607)

MCL1-m2929 Target:
5'-ATCCTTGATCATAGTTTGCTTATTTAT-3' (SEQ ID NO: 922)

5'-AGAGCACUUUAUGUAGUUGAAUAAA$^A$A-3'  (SEQ ID NO: 1868)
3'-UCUCGUGAAAUACAUCAACUUAUUU$_{G-5'}$G (SEQ ID NO: 608)

MCL1-m2975 Target:
5'-AGAGCACTTTATGTAGTTGAATAAACC-3' (SEQ ID NO: 923)

5'-GAGCACUUUAUGUAGUUGAAUAAAC$^A$A-3'  (SEQ ID NO: 1869)
3'-CUCGUGAAAUACAUCAACUUAUUUG$_{G-5'}$G (SEQ ID NO: 609)

MCL1-m2976 Target:
5'-GAGCACTTTATGTAGTTGAATAAACCC-3' (SEQ ID NO: 924)

5'-UUUGUUUACUAGGAGCCUGACUUCC$_A$C-3'  (SEQ ID NO: 1870)
3'-AAACAAAUGAUCCUCGGACUGAAGG$_{U-5'}$G (SEQ ID NO: 610)

MCL1-m3055 Target:
5'-TTTGTTTACTAGGAGCCTGACTTCCCA-3' (SEQ ID NO: 925)

5'-AGCCUGACUUCCCAGCUCACAAAGG$_A$C-3'  (SEQ ID NO: 1871)
3'-UCGGACUGAAGGGUCGAGUGUUUCC$_{A-5'}$C (SEQ ID NO: 611)

MCL1-m3068 Target:
5'-AGCCTGACTTCCCAGCTCACAAAGGGT-3' (SEQ ID NO: 926)

5'-GCCUGACUUCCCAGCUCACAAAGGG$^C$A-3'  (SEQ ID NO: 1872)
3'-CGGACUGAAGGGUCGAGUGUUUCCC$_{A-5'}$A (SEQ ID NO: 612)

MCL1-m3069 Target:
5'-GCCTGACTTCCCAGCTCACAAAGGGTG-3' (SEQ ID NO: 927)

5'-CCUGACUUCCCAGCUCACAAAGGGU$_A$C-3'  (SEQ ID NO: 1873)
3'-GGACUGAAGGGUCGAGUGUUUCCCA$_{U-5'}$C (SEQ ID NO: 613)

MCL1-m3070 Target:
5'-CCTGACTTCCCAGCTCACAAAGGGTGA-3' (SEQ ID NO: 928)

5'-UCCCAGCUCACAAAGGGUGAAAUGA$_A$C-3'  (SEQ ID NO: 1874)
3'-AGGGUCGAGUGUUUCCCACUUUACU$_{U-5'}$C (SEQ ID NO: 614)

MCL1-m3077 Target:
5'-TCCCAGCTCACAAAGGGTGAAATGAAA-3' (SEQ ID NO: 929)

5'-AGCUCACAAAGGGUGAAAUGAAAGC$^C$A-3'  (SEQ ID NO: 1875)
3'-UCGAGUGUUUCCCACUUUACUUUCG$_{A-5'}$C (SEQ ID NO: 615)

MCL1-m3081 Target:
5'-AGCTCACAAAGGGTGAAATGAAAGCTG-3' (SEQ ID NO: 930)

5'-GCUGAAGUACAGACAGGAUCUUAGU$^C$A-3'  (SEQ ID NO: 1876)
3'-CGACUUCAUGUCUGUCCUAGAAUCA$_{U-5'}$C (SEQ ID NO: 616)

MCL1-m3104 Target:
5'-GCTGAAGTACAGACAGGATCTTAGTAG-3' (SEQ ID NO: 931)

5'-GAAGUACAGACAGGAUCUUAGUAGG$_C$C-3'  (SEQ ID NO: 1877)
3'-CUUCAUGUCUGUCCUAGAAUCAUCC$_{U-5'}$A (SEQ ID NO: 617)

MCL1-m3107 Target:
5'-GAAGTACAGACAGGATCTTAGTAGGTA-3' (SEQ ID NO: 932)

5'-GGGCCAUGAAGACUUGGAGAGCGCA$_A$C-3'  (SEQ ID NO: 1878)
3'-CCCGGUACUUCUGAACCUCUCGCGU$_{A-5'}$C (SEQ ID NO: 618)

MCL1-m3145 Target:
5'-GGGCCATGAAGACTTGGAGAGCGCAGT-3' (SEQ ID NO: 933)

5'-CUUUGGAGGGAAGAAGCAUGUGGUC$^C$A-3'  (SEQ ID NO: 1879)
3'-GAAACCUCCCUUCUUCGUACACCAG$_{A-5'}$C (SEQ ID NO: 619)

MCL1-m3189 Target:
5'-CTTTGGAGGGAAGAAGCATGTGGTCTG-3' (SEQ ID NO: 934)

5'-UGAGUGCUGACUAGAUGAAUAGUUG$^C$A-3'  (SEQ ID NO: 1880)
3'-ACUCACGACUGAUCUACUUAUCAAC$_{U-5'}$C (SEQ ID NO: 620)

MCL1-m3214 Target:
5'-TGAGTGCTGACTAGATGAATAGTTGAG-3' (SEQ ID NO: 935)

5'-GCUGACUAGAUGAAUAGUUGAGGCA$^A$C-3'  (SEQ ID NO: 1881)
3'-CGACUGAUCUACUUAUCAACUCCGU$_{G-5'}$U (SEQ ID NO: 621)

MCL1-m3219 Target:
5'-GCTGACTAGATGAATAGTTGAGGCACA-3' (SEQ ID NO: 936)

5'-UGAGGCACAUCCUUCAGAGAAGAGG$^A$C-3'  (SEQ ID NO: 1882)
3'-ACUCCGUGUAGGAAGUCUCUUCUCC$_{U-5'}$C (SEQ ID NO: 622)

MCL1-m3237 Target:
5'-TGAGGCACATCCTTCAGAAGAGGGA-3' (SEQ ID NO: 937)

5'-GAGGCACAUCCUUCAGAGAAGAGGG$^C$A-3'  (SEQ ID NO: 1883)
3'-CUCCGUGUAGGAAGUCUCUUCUCCC$_{U-5'}$C (SEQ ID NO: 623)

TABLE 8-continued

Selected Mouse Anti-MCL1 "Blunt/Fray" DsiRNAs

MCL1-m3238 Target:
5'-GAGGCACATCCTTCAGAGAAGAGGGAG-3' (SEQ ID NO: 938)

5'-GGGCUGCUUGGAAAGAUGGCUCUCA$^{AA\text{-}3'}$ (SEQ ID NO: 1884)
3'-CCCGACGAACCUUUCUACCGAGAGU$_{C_{G\text{-}5'}}$ (SEQ ID NO: 624)

MCL1-m3265 Target:
5'-GGGCTGCTTGGAAAGATGGCTCTCAGC-3' (SEQ ID NO: 939)

5'-AAUCUGUUUGUCUUACACGUCUCUC$^{CA\text{-}3'}$ (SEQ ID NO: 1885)
3'-UUAGACAAACAGAAUGUGCAGAGAG$_{U_{C\text{-}5'}}$ (SEQ ID NO: 625)

MCL1-m3294 Target:
5'-AATCTGTTTGTCTTACACGTCTCTCAG-3' (SEQ ID NO: 940)

5'-CAAGCAUCUUCCAUGUACAUUCUAU$^{AC\text{-}3'}$ (SEQ ID NO: 1886)
3'-GUUCGUAGAAGGUACAUGUAAGAUA$_{G_{A\text{-}5'}}$ (SEQ ID NO: 626)

MCL1-m3340 Target:
5'-CAAGCATCTTCCATGTACATTCTATCT-3' (SEQ ID NO: 941)

5'-GAGCACCUAACACUUUAACAGCUGU$^{CA\text{-}3'}$ (SEQ ID NO: 1887)
3'-CUCGUGGAUUGUGAAAUUGUCGACA$_{A_{G\text{-}5'}}$ (SEQ ID NO: 627)

MCL1-m3390 Target:
5'-GAGCACCTAACACTTTAACAGCTGTTC-3' (SEQ ID NO: 942)

TABLE 8-continued

Selected Mouse Anti-MCL1 "Blunt/Fray" DsiRNAs

5'-ACAGCUGUUCCCGAAAGGGUUAGGA$^{AA\text{-}3'}$ (SEQ ID NO: 1888)
3'-UGUCGACAAGGGCUUUCCCAAUCCU$_{G_{G\text{-}5'}}$ (SEQ ID NO: 628)

MCL1-m3407 Target:
5'-ACAGCTGTTCCCGAAAGGGTTAGGACC-3' (SEQ ID NO: 943)

5'-CCCGAAAGGGUUAGGACCAACUGCA$^{CA\text{-}3'}$ (SEQ ID NO: 1889)
3'-GGGCUUUCCCAAUCCUGGUUGACGU$_{C_{U\text{-}5'}}$ (SEQ ID NO: 629)

MCL1-m3416 Target:
5'-CCCGAAAGGGTTAGGACCAACTGCAAG-3' (SEQ ID NO: 944)

5'-GACCAACUGCAAGUUAAUGUGGGUU$^{AC\text{-}3'}$ (SEQ ID NO: 1890)
3'-CUGGUUGACGUUCAAUUACACCCAA$_{C_{A\text{-}5'}}$ (SEQ ID NO: 630)

MCL1-m3430 Target:
5'-GACCAACTGCAAGTTAATGTGGGTTGT-3' (SEQ ID NO: 945)

5'-CCCUGGAAGAGUCACUGUCUGAAUG$^{CC\text{-}3'}$ (SEQ ID NO: 2781)
3'-GGGACCUUCUCAGUGACAGACUUAC$_{U_{U\text{-}5'}}$ (SEQ ID NO: 2397)

MCL1-m1355 Target:
5'-CCCTGGAAGAGTCACTGTCTGAATGAA-3' (SEQ ID NO: 2493)

TABLE 9

| Selected Human Anti-MCL1 "Blunt/Blunt" DsiRNAs | | |
|---|---|---|
| | 5'-UCGCCACUUCUCACUUCCGCUUCCUUC-3' | (SEQ ID NO: 1891) |
| | 3'-AGCGGUGAAGAGUGAAGGCGAAGGAAG-5' | (SEQ ID NO: 316) |
| MCL1-72 Target: | 5'-TCGCCACTTCTCACTTCCGCTTCCTTC-3' | (SEQ ID NO: 631) |
| | 5'-CCACUUCUCACUUCCGCUUCCUUCCAG-3' | (SEQ ID NO: 1892) |
| | 3'-GGUGAAGAGUGAAGGCGAAGGAAGGUC-5' | (SEQ ID NO: 317) |
| MCL1-75 Target: | 5'-CCACTTCTCACTTCCGCTTCCTTCCAG-3' | (SEQ ID NO: 632) |
| | 5'-GCGGCGGCGACUGGCAAUGUUUGGCCU-3' | (SEQ ID NO: 1893) |
| | 3'-CGCCGCCGCUGACCGUUACAAACCGGA-5' | (SEQ ID NO: 318) |
| MCL1-141 Target: | 5'-GCGGCGGCGACTGGCAATGTTTGGCCT-3' | (SEQ ID NO: 633) |
| | 5'-AACGCGGUAAUCGGACUCAACCUCUAC-3' | (SEQ ID NO: 1894) |
| | 3'-UUGCGCCAUUAGCCUGAGUUGGAGAUG-5' | (SEQ ID NO: 319) |
| MCL1-175 Target: | 5'-AACGCGGTAATCGGACTCAACCTCTAC-3' | (SEQ ID NO: 634) |
| | 5'-GGAGGGCGACUUUUGGCUACGGAGAAG-3' | (SEQ ID NO: 1895) |
| | 3'-CCUCCCGCUGAAAACCGAUGCCUCUUC-5' | (SEQ ID NO: 320) |
| MCL1-250 Target: | 5'-GGAGGGCGACTTTTGGCTACGGAGAAG-3' | (SEQ ID NO: 635) |
| | 5'-CCGCGAGGCUGCUUUUCUUCGCGCCCA-3' | (SEQ ID NO: 1896) |
| | 3'-GGCGCUCCGACGAAAAGAAGCGCGGGU-5' | (SEQ ID NO: 321) |
| MCL1-434 Target: | 5'-CCGCGAGGCTGCTTTTCTTCGCGCCCA-3' | (SEQ ID NO: 636) |
| | 5'-UCUGGUAAUAACACCAGUACGGACGGG-3' | (SEQ ID NO: 1897) |
| | 3'-AGACCAUUAUUGUGGUCAUGCCUGCCC-5' | (SEQ ID NO: 322) |
| MCL1-604 Target: | 5'-TCTGGTAATAACACCAGTACGGACGGG-3' | (SEQ ID NO: 637) |
| | 5'-GAGGAGGAGGACGAGUUGUACCGGCAG-3' | (SEQ ID NO: 1898) |
| | 3'-CUCCUCCUCCUGCUCAACAUGGCCGUC-5' | (SEQ ID NO: 323) |
| MCL1-661 Target: | 5'-GAGGAGGAGGACGAGTTGTACCGGCAG-3' | (SEQ ID NO: 638) |
| | 5'-ACCGGCAGUCGCUGGAGAUUAUCUCUC-3' | (SEQ ID NO: 1899) |
| | 3'-UGGCCGUCAGCGACCUCUAAUAGAGAG-5' | (SEQ ID NO: 324) |
| MCL1-680 Target: | 5'-ACCGGCAGTCGCTGGAGATTATCTCTC-3' | (SEQ ID NO: 639) |

TABLE 9-continued

Selected Human Anti-MCL1 "Blunt/Blunt" DsiRNAs

|  |  |  |
|---|---|---|
| MCL1-733 Target: | 5'-GCCAAGGACACAAAGCCAAUGGGCAGG-3'<br>3'-CGGUUCCUGUGUUUCGGUUACCCGUCC-5'<br>5'-GCCAAGGACACAAAGCCAATGGGCAGG-3' | (SEQ ID NO: 1900)<br>(SEQ ID NO: 325)<br>(SEQ ID NO: 640) |
| MCL1-774 Target: | 5'-CAGGAAGGCGCUGGAGACCUUACGACG-3'<br>3'-GUCCUUCCGCGACCUCUGGAAUGCUGC-5'<br>5'-CAGGAAGGCGCTGGAGACCTTACGACG-3' | (SEQ ID NO: 1901)<br>(SEQ ID NO: 326)<br>(SEQ ID NO: 641) |
| MCL1-809 Target: | 5'-AUGGCGUGCAGCGCAACCACGAGACGG-3'<br>3'-UACCGCACGUCGCGUUGGUGCUCUGCC-5'<br>5'-ATGGCGTGCAGCGCAACCACGAGACGG-3' | (SEQ ID NO: 1902)<br>(SEQ ID NO: 327)<br>(SEQ ID NO: 642) |
| MCL1-810 Target: | 5'-UGGCGUGCAGCGCAACCACGAGACGGC-3'<br>3'-ACCGCACGUCGCGUUGGUGCUCUGCCG-5'<br>5'-TGGCGTGCAGCGCAACCACGAGACGGC-3' | (SEQ ID NO: 1903)<br>(SEQ ID NO: 328)<br>(SEQ ID NO: 643) |
| MCL1-811 Target: | 5'-GGCGUGCAGCGCAACCACGAGACGGCC-3'<br>3'-CCGCACGUCGCGUUGGUGCUCUGCCGG-5'<br>5'-GGCGTGCAGCGCAACCACGAGACGGCC-3' | (SEQ ID NO: 1904)<br>(SEQ ID NO: 329)<br>(SEQ ID NO: 644) |
| MCL1-812 Target: | 5'-GCGUGCAGCGCAACCACGAGACGGCCU-3'<br>3'-CGCACGUCGCGUUGGUGCUCUGCCGGA-5'<br>5'-GCGTGCAGCGCAACCACGAGACGGCCT-3' | (SEQ ID NO: 1905)<br>(SEQ ID NO: 330)<br>(SEQ ID NO: 645) |
| MCL1-813 Target: | 5'-CGUGCAGCGCAACCACGAGACGGCCUU-3'<br>3'-GCACGUCGCGUUGGUGCUCUGCCGGAA-5'<br>5'-CGTGCAGCGCAACCACGAGACGGCCTT-3' | (SEQ ID NO: 1906)<br>(SEQ ID NO: 331)<br>(SEQ ID NO: 646) |
| MCL1-814 Target: | 5'-GUGCAGCGCAACCACGAGACGGCCUUC-3'<br>3'-CACGUCGCGUUGGUGCUCUGCCGGAAG-5'<br>5'-GTGCAGCGCAACCACGAGACGGCCTTC-3' | (SEQ ID NO: 1907)<br>(SEQ ID NO: 332)<br>(SEQ ID NO: 647) |
| MCL1-815 Target: | 5'-UGCAGCGCAACCACGAGACGGCCUUCC-3'<br>3'-ACGUCGCGUUGGUGCUCUGCCGGAAGG-5'<br>5'-TGCAGCGCAACCACGAGACGGCCTTCC-3' | (SEQ ID NO: 1908)<br>(SEQ ID NO: 333)<br>(SEQ ID NO: 648) |
| MCL1-816 Target: | 5'-GCAGCGCAACCACGAGACGGCCUUCCA-3'<br>3'-CGUCGCGUUGGUGCUCUGCCGGAAGGU-5'<br>5'-GCAGCGCAACCACGAGACGGCCTTCCA-3' | (SEQ ID NO: 1909)<br>(SEQ ID NO: 334)<br>(SEQ ID NO: 649) |
| MCL1-817 Target: | 5'-CAGCGCAACCACGAGACGGCCUUCCAA-3'<br>3'-GUCGCGUUGGUGCUCUGCCGGAAGGUU-5'<br>5'-CAGCGCAACCACGAGACGGCCTTCCAA-3' | (SEQ ID NO: 1910)<br>(SEQ ID NO: 335)<br>(SEQ ID NO: 650) |
| MCL1-818 Target: | 5'-AGCGCAACCACGAGACGGCCUUCCAAG-3'<br>3'-UCGCGUUGGUGCUCUGCCGGAAGGUUC-5'<br>5'-AGCGCAACCACGAGACGGCCTTCCAAG-3' | (SEQ ID NO: 1911)<br>(SEQ ID NO: 336)<br>(SEQ ID NO: 651) |
| MCL1-819 Target: | 5'-GCGCAACCACGAGACGGCCUUCCAAGG-3'<br>3'-CGCGUUGGUGCUCUGCCGGAAGGUUCC-5'<br>5'-GCGCAACCACGAGACGGCCTTCCAAGG-3' | (SEQ ID NO: 1912)<br>(SEQ ID NO: 337)<br>(SEQ ID NO: 652) |
| MCL1-820 Target: | 5'-CGCAACCACGAGACGGCCUUCCAAGGC-3'<br>3'-GCGUUGGUGCUCUGCCGGAAGGUUCCG-5'<br>5'-CGCAACCACGAGACGGCCTTCCAAGGC-3' | (SEQ ID NO: 1913)<br>(SEQ ID NO: 338)<br>(SEQ ID NO: 653) |
| MCL1-821 Target: | 5'-GCAACCACGAGACGGCCUUCCAAGGCA-3'<br>3'-CGUUGGUGCUCUGCCGGAAGGUUCCGU-5'<br>5'-GCAACCACGAGACGGCCTTCCAAGGCA-3' | (SEQ ID NO: 1914)<br>(SEQ ID NO: 339)<br>(SEQ ID NO: 654) |
| MCL1-822 Target: | 5'-CAACCACGAGACGGCCUUCCAAGGCAU-3'<br>3'-GUUGGUGCUCUGCCGGAAGGUUCCGUA-5'<br>5'-CAACCACGAGACGGCCTTCCAAGGCAT-3' | (SEQ ID NO: 1915)<br>(SEQ ID NO: 340)<br>(SEQ ID NO: 655) |
| MCL1-838 Target: | 5'-UUCCAAGGCAUGCUUCGGAAACUGGAC-3'<br>3'-AAGGUUCCGUACGAAGCCUUUGACCUG-5'<br>5'-TTCCAAGGCATGCTTCGGAAACTGGAC-3' | (SEQ ID NO: 1916)<br>(SEQ ID NO: 341)<br>(SEQ ID NO: 656) |
| MCL1-839 Target: | 5'-UCCAAGGCAUGCUUCGGAAACUGGACA-3'<br>3'-AGGUUCCGUACGAAGCCUUUGACCUGU-5'<br>5'-TCCAAGGCATGCTTCGGAAACTGGACA-3' | (SEQ ID NO: 1917)<br>(SEQ ID NO: 342)<br>(SEQ ID NO: 657) |
| MCL1-871 Target: | 5'-AACGAAGACGAUGUGAAAUCGUUGUCU-3'<br>3'-UUGCUUCUGCUACACUUUAGCAACAGA-5'<br>5'-AACGAAGACGATGTGAAATCGTTGTCT-3' | (SEQ ID NO: 1918)<br>(SEQ ID NO: 343)<br>(SEQ ID NO: 658) |

TABLE 9-continued

Selected Human Anti-MCL1 "Blunt/Blunt" DsiRNAs

|  |  |  |
|---|---|---|
| MCL1-877 Target: | 5'-GACGAUGUGAAAUCGUUGUCUCGAGUG-3'<br>3'-CUGCUACACUUUAGCAACAGAGCUCAC-5'<br>5'-GACGATGTGAAATCGTTGTCTCGAGTG-3' | (SEQ ID NO: 1919)<br>(SEQ ID NO: 344)<br>(SEQ ID NO: 659) |
| MCL1-939 Target: | 5'-GGGCAGGAUUGUGACUCUCAUUUCUUU-3'<br>3'-CCCGUCCUAACACUGAGAGUAAAGAAA-5'<br>5'-GGGCAGGATTGTGACTCTCATTTCTTT-3' | (SEQ ID NO: 1920)<br>(SEQ ID NO: 345)<br>(SEQ ID NO: 660) |
| MCL1-947 Target: | 5'-UUGUGACUCUCAUUUCUUUUGGUGCCU-3'<br>3'-AACACUGAGAGUAAAGAAAACCACGGA-5'<br>5'-TTGTGACTCTCATTTCTTTTGGTGCCT-3' | (SEQ ID NO: 1921)<br>(SEQ ID NO: 346)<br>(SEQ ID NO: 661) |
| MCL1-970 Target: | 5'-GCCUUUGUGGCUAAACACUUGAAGACC-3'<br>3'-CGGAAACACCGAUUUGUGAACUUCUGG-5'<br>5'-GCCTTTGTGGCTAAACACTTGAAGACC-3' | (SEQ ID NO: 1922)<br>(SEQ ID NO: 347)<br>(SEQ ID NO: 662) |
| MCL1-975 Target: | 5'-UGUGGCUAAACACUUGAAGACCAUAAA-3'<br>3'-ACACCGAUUUGUGAACUUCUGGUAUUU-5'<br>5'-TGTGGCTAAACACTTGAAGACCATAAA-3' | (SEQ ID NO: 1923)<br>(SEQ ID NO: 348)<br>(SEQ ID NO: 663) |
| MCL1-976 Target: | 5'-GUGGCUAAACACUUGAAGACCAUAAAC-3'<br>3'-CACCGAUUUGUGAACUUCUGGUAUUUG-5'<br>5'-GTGGCTAAACACTTGAAGACCATAAAC-3' | (SEQ ID NO: 1924)<br>(SEQ ID NO: 349)<br>(SEQ ID NO: 664) |
| MCL1-977 Target: | 5'-UGGCUAAACACUUGAAGACCAUAAACC-3'<br>3'-ACCGAUUUGUGAACUUCUGGUAUUUGG-5'<br>5'-TGGCTAAACACTTGAAGACCATAAACC-3' | (SEQ ID NO: 1925)<br>(SEQ ID NO: 350)<br>(SEQ ID NO: 665) |
| MCL1-978 Target: | 5'-GGCUAAACACUUGAAGACCAUAAACCA-3'<br>3'-CCGAUUUGUGAACUUCUGGUAUUUGGU-5'<br>5'-GGCTAAACACTTGAAGACCATAAACCA-3' | (SEQ ID NO: 1926)<br>(SEQ ID NO: 351)<br>(SEQ ID NO: 666) |
| MCL1-984 Target: | 5'-ACACUUGAAGACCAUAAACCAAGAAAG-3'<br>3'-UGUGAACUUCUGGUAUUUGGUUCUUUC-5'<br>5'-ACACTTGAAGACCATAAACCAAGAAAG-3' | (SEQ ID NO: 1927)<br>(SEQ ID NO: 352)<br>(SEQ ID NO: 667) |
| MCL1-985 Target: | 5'-CACUUGAAGACCAUAAACCAAGAAAGC-3'<br>3'-GUGAACUUCUGGUAUUUGGUUCUUUCG-5'<br>5'-CACTTGAAGACCATAAACCAAGAAAGC-3' | (SEQ ID NO: 1928)<br>(SEQ ID NO: 353)<br>(SEQ ID NO: 668) |
| MCL1-990 Target: | 5'-GAAGACCAUAAACCAAGAAAGCUGCAU-3'<br>3'-CUUCUGGUAUUUGGUUCUUUCGACGUA-5'<br>5'-GAAGACCATAAACCAAGAAAGCTGCAT-3' | (SEQ ID NO: 1929)<br>(SEQ ID NO: 354)<br>(SEQ ID NO: 669) |
| MCL1-1012 Target: | 5'-UGCAUCGAACCAUUAGCAGAAAGUAUC-3'<br>3'-ACGUAGCUUGGUAAUCGUCUUUCAUAG-5'<br>5'-TGCATCGAACCATTAGCAGAAAGTATC-3' | (SEQ ID NO: 1930)<br>(SEQ ID NO: 355)<br>(SEQ ID NO: 670) |
| MCL1-1013 Target: | 5'-GCAUCGAACCAUUAGCAGAAAGUAUCA-3'<br>3'-CGUAGCUUGGUAAUCGUCUUUCAUAGU-5'<br>5'-GCATCGAACCATTAGCAGAAAGTATCA-3' | (SEQ ID NO: 1931)<br>(SEQ ID NO: 356)<br>(SEQ ID NO: 671) |
| MCL1-1018 Target: | 5'-GAACCAUUAGCAGAAAGUAUCACAGAC-3'<br>3'-CUUGGUAAUCGUCUUUCAUAGUGUCUG-5'<br>5'-GAACCATTAGCAGAAAGTATCACAGAC-3' | (SEQ ID NO: 1932)<br>(SEQ ID NO: 357)<br>(SEQ ID NO: 672) |
| MCL1-1062 Target: | 5'-ACGGGACUGGCUAGUUAAACAAAGAGG-3'<br>3'-UGCCCUGACCGAUCAAUUUGUUUCUCC-5'<br>5'-ACGGGACTGGCTAGTTAAACAAAGAGG-3' | (SEQ ID NO: 1933)<br>(SEQ ID NO: 358)<br>(SEQ ID NO: 673) |
| MCL1-1063 Target: | 5'-CGGGACUGGCUAGUUAAACAAAGAGGC-3'<br>3'-GCCCUGACCGAUCAAUUUGUUUCUCCG-5'<br>5'-CGGGACTGGCTAGTTAAACAAAGAGGC-3' | (SEQ ID NO: 1934)<br>(SEQ ID NO: 359)<br>(SEQ ID NO: 674) |
| MCL1-1070 Target: | 5'-GGCUAGUUAAACAAAGAGGCUGGGAUG-3'<br>3'-CCGAUCAAUUUGUUUCUCCGACCCUAC-5'<br>5'-GGCTAGTTAAACAAAGAGGCTGGGATG-3' | (SEQ ID NO: 1935)<br>(SEQ ID NO: 360)<br>(SEQ ID NO: 675) |
| MCL1-1076 Target: | 5'-UUAAACAAAGAGGCUGGGAUGGGUUUG-3'<br>3'-AAUUUGUUUCUCCGACCCUACCCAAAC-5'<br>5'-TTAAACAAAGAGGCTGGGATGGGTTTG-3' | (SEQ ID NO: 1936)<br>(SEQ ID NO: 361)<br>(SEQ ID NO: 676) |
| MCL1-1077 Target: | 5'-UAAACAAAGAGGCUGGGAUGGGUUUGU-3'<br>3'-AUUUGUUUCUCCGACCCUACCCAAACA-5'<br>5'-TAAACAAAGAGGCTGGGATGGGTTTGT-3' | (SEQ ID NO: 1937)<br>(SEQ ID NO: 362)<br>(SEQ ID NO: 677) |

TABLE 9-continued

Selected Human Anti-MCL1 "Blunt/Blunt" DsiRNAs

|  |  |  |
|---|---|---|
| MCL1-1078 Target: | 5'-AAACAAAGAGGCUGGGAUGGGUUUGUG-3'<br>3'-UUUGUUUCUCCGACCCUACCCAAACAC-5'<br>5'-AAACAAAGAGGCTGGGATGGGTTTGTG-3' | (SEQ ID NO: 1938)<br>(SEQ ID NO: 363)<br>(SEQ ID NO: 678) |
| MCL1-1079 Target: | 5'-AACAAAGAGGCUGGGAUGGGUUUGUGG-3'<br>3'-UUGUUUCUCCGACCCUACCCAAACACC-5'<br>5'-AACAAAGAGGCTGGGATGGGTTTGTGG-3' | (SEQ ID NO: 1939)<br>(SEQ ID NO: 364)<br>(SEQ ID NO: 679) |
| MCL1-1080 Target: | 5'-ACAAAGAGGCUGGGAUGGGUUUGUGGA-3'<br>3'-UGUUUCUCCGACCCUACCCAAACACCU-5'<br>5'-ACAAAGAGGCTGGGATGGGTTTGTGGA-3' | (SEQ ID NO: 1940)<br>(SEQ ID NO: 365)<br>(SEQ ID NO: 680) |
| MCL1-1081 Target: | 5'-CAAAGAGGCUGGGAUGGGUUUGUGGAG-3'<br>3'-GUUUCUCCGACCCUACCCAAACACCUC-5'<br>5'-CAAAGAGGCTGGGATGGGTTTGTGGAG-3' | (SEQ ID NO: 1941)<br>(SEQ ID NO: 366)<br>(SEQ ID NO: 681) |
| MCL1-1082 Target: | 5'-AAAGAGGCUGGGAUGGGUUUGUGGAGU-3'<br>3'-UUUCUCCGACCCUACCCAAACACCUCA-5'<br>5'-AAAGAGGCTGGGATGGGTTTGTGGAGT-3' | (SEQ ID NO: 1942)<br>(SEQ ID NO: 367)<br>(SEQ ID NO: 682) |
| MCL1-1083 Target: | 5'-AAGAGGCUGGGAUGGGUUUGUGGAGUU-3'<br>3'-UUCUCCGACCCUACCCAAACACCUCAA-5'<br>5'-AAGAGGCTGGGATGGGTTTGTGGAGTT-3' | (SEQ ID NO: 1943)<br>(SEQ ID NO: 368)<br>(SEQ ID NO: 683) |
| MCL1-1084 Target: | 5'-AGAGGCUGGGAUGGGUUUGUGGAGUUC-3'<br>3'-UCUCCGACCCUACCCAAACACCUCAAG-5'<br>5'-AGAGGCTGGGATGGGTTTGTGGAGTTC-3' | (SEQ ID NO: 1944)<br>(SEQ ID NO: 369)<br>(SEQ ID NO: 684) |
| MCL1-1085 Target: | 5'-GAGGCUGGGAUGGGUUUGUGGAGUUCU-3'<br>3'-CUCCGACCCUACCCAAACACCUCAAGA-5'<br>5'-GAGGCTGGGATGGGTTTGTGGAGTTCT-3' | (SEQ ID NO: 1945)<br>(SEQ ID NO: 370)<br>(SEQ ID NO: 685) |
| MCL1-1086 Target: | 5'-AGGCUGGGAUGGGUUUGUGGAGUUCUU-3'<br>3'-UCCGACCCUACCCAAACACCUCAAGAA-5'<br>5'-AGGCTGGGATGGGTTTGTGGAGTTCTT-3' | (SEQ ID NO: 1946)<br>(SEQ ID NO: 371)<br>(SEQ ID NO: 686) |
| MCL1-1087 Target: | 5'-GGCUGGGAUGGGUUUGUGGAGUUCUUC-3'<br>3'-CCGACCCUACCCAAACACCUCAAGAAG-5'<br>5'-GGCTGGGATGGGTTTGTGGAGTTCTTC-3' | (SEQ ID NO: 1947)<br>(SEQ ID NO: 372)<br>(SEQ ID NO: 687) |
| MCL1-1088 Target: | 5'-GCUGGGAUGGGUUUGUGGAGUUCUUCC-3'<br>3'-CGACCCUACCCAAACACCUCAAGAAGG-5'<br>5'-GCTGGGATGGGTTTGTGGAGTTCTTCC-3' | (SEQ ID NO: 1948)<br>(SEQ ID NO: 373)<br>(SEQ ID NO: 688) |
| MCL1-1089 Target: | 5'-CUGGGAUGGGUUUGUGGAGUUCUUCCA-3'<br>3'-GACCCUACCCAAACACCUCAAGAAGGU-5'<br>5'-CTGGGATGGGTTTGTGGAGTTCTTCCA-3' | (SEQ ID NO: 1949)<br>(SEQ ID NO: 374)<br>(SEQ ID NO: 689) |
| MCL1-1090 Target: | 5'-UGGGAUGGGUUUGUGGAGUUCUUCCAU-3'<br>3'-ACCCUACCCAAACACCUCAAGAAGGUA-5'<br>5'-TGGGATGGGTTTGTGGAGTTCTTCCAT-3' | (SEQ ID NO: 1950)<br>(SEQ ID NO: 375)<br>(SEQ ID NO: 690) |
| MCL1-1091 Target: | 5'-GGGAUGGGUUUGUGGAGUUCUUCCAUG-3'<br>3'-CCCUACCCAAACACCUCAAGAAGGUAC-5'<br>5'-GGGATGGGTTTGTGGAGTTCTTCCATG-3' | (SEQ ID NO: 1951)<br>(SEQ ID NO: 376)<br>(SEQ ID NO: 691) |
| MCL1-1092 Target: | 5'-GGAUGGGUUUGUGGAGUUCUUCCAUGU-3'<br>3'-CCUACCCAAACACCUCAAGAAGGUACA-5'<br>5'-GGATGGGTTTGTGGAGTTCTTCCATGT-3' | (SEQ ID NO: 1952)<br>(SEQ ID NO: 377)<br>(SEQ ID NO: 692) |
| MCL1-1093 Target: | 5'-GAUGGGUUUGUGGAGUUCUUCCAUGUA-3'<br>3'-CUACCCAAACACCUCAAGAAGGUACAU-5'<br>5'-GATGGGTTTGTGGAGTTCTTCCATGTA-3' | (SEQ ID NO: 1953)<br>(SEQ ID NO: 378)<br>(SEQ ID NO: 693) |
| MCL1-1094 Target: | 5'-AUGGGUUUGUGGAGUUCUUCCAUGUAG-3'<br>3'-UACCCAAACACCUCAAGAAGGUACAUC-5'<br>5'-ATGGGTTTGTGGAGTTCTTCCATGTAG-3' | (SEQ ID NO: 1954)<br>(SEQ ID NO: 379)<br>(SEQ ID NO: 694) |
| MCL1-1095 Target: | 5'-UGGGUUUGUGGAGUUCUUCCAUGUAGA-3'<br>3'-ACCCAAACACCUCAAGAAGGUACAUCU-5'<br>5'-TGGGTTTGTGGAGTTCTTCCATGTAGA-3' | (SEQ ID NO: 1955)<br>(SEQ ID NO: 380)<br>(SEQ ID NO: 695) |
| MCL1-1104 Target: | 5'-GGAGUUCUUCCAUGUAGAGGACCUAGA-3'<br>3'-CCUCAAGAAGGUACAUCUCCUGGAUCU-5'<br>5'-GGAGTTCTTCCATGTAGAGGACCTAGA-3' | (SEQ ID NO: 1956)<br>(SEQ ID NO: 381)<br>(SEQ ID NO: 696) |

TABLE 9-continued

Selected Human Anti-MCL1 "Blunt/Blunt" DsiRNAs

|  |  |  |
|---|---|---|
| MCL1-1111 | 5'-UUCCAUGUAGAGGACCUAGAAGGUGGC-3'<br>3'-AAGGUACAUCUCCUGGAUCUUCCACCG-5'<br>Target: 5'-TTCCATGTAGAGGACCTAGAAGGTGGC-3' | (SEQ ID NO: 1957)<br>(SEQ ID NO: 382)<br>(SEQ ID NO: 697) |
| MCL1-1120 | 5'-GAGGACCUAGAAGGUGGCAUCAGGAAU-3'<br>3'-CUCCUGGAUCUUCCACCGUAGUCCUUA-5'<br>Target: 5'-GAGGACCTAGAAGGTGGCATCAGGAAT-3' | (SEQ ID NO: 1958)<br>(SEQ ID NO: 383)<br>(SEQ ID NO: 698) |
| MCL1-1163 | 5'-CAGGUGUUGCUGGAGUAGGAGCUGGUU-3'<br>3'-GUCCACAACGACCUCAUCCUCGACCAA-5'<br>Target: 5'-CAGGTGTTGCTGGAGTAGGAGCTGGTT-3' | (SEQ ID NO: 1959)<br>(SEQ ID NO: 384)<br>(SEQ ID NO: 699) |
| MCL1-1182 | 5'-AGCUGGUUUGGCAUAUCUAAUAAGAUA-3'<br>3'-UCGACCAAACCGUAUAGAUUAUUCUAU-5'<br>Target: 5'-AGCTGGTTTGGCATATCTAATAAGATA-3' | (SEQ ID NO: 1960)<br>(SEQ ID NO: 385)<br>(SEQ ID NO: 700) |
| MCL1-1188 | 5'-UUUGGCAUAUCUAAUAAGAUAGCCUUA-3'<br>3'-AAACCGUAUAGAUUAUUCUAUCGGAAU-5'<br>Target: 5'-TTTGGCATATCTAATAAGATAGCCTTA-3' | (SEQ ID NO: 1961)<br>(SEQ ID NO: 386)<br>(SEQ ID NO: 701) |
| MCL1-1189 | 5'-UUGGCAUAUCUAAUAAGAUAGCCUUAC-3'<br>3'-AACCGUAUAGAUUAUUCUAUCGGAAUG-5'<br>Target: 5'-TTGGCATATCTAATAAGATAGCCTTAC-3' | (SEQ ID NO: 1962)<br>(SEQ ID NO: 387)<br>(SEQ ID NO: 702) |
| MCL1-1190 | 5'-UGGCAUAUCUAAUAAGAUAGCCUUACU-3'<br>3'-ACCGUAUAGAUUAUUCUAUCGGAAUGA-5'<br>Target: 5'-TGGCATATCTAATAAGATAGCCTTACT-3' | (SEQ ID NO: 1963)<br>(SEQ ID NO: 388)<br>(SEQ ID NO: 703) |
| MCL1-1191 | 5'-GGCAUAUCUAAUAAGAUAGCCUUACUG-3'<br>3'-CCGUAUAGAUUAUUCUAUCGGAAUGAC-5'<br>Target: 5'-GGCATATCTAATAAGATAGCCTTACTG-3' | (SEQ ID NO: 1964)<br>(SEQ ID NO: 389)<br>(SEQ ID NO: 704) |
| MCL1-1192 | 5'-GCAUAUCUAAUAAGAUAGCCUUACUGU-3'<br>3'-CGUAUAGAUUAUUCUAUCGGAAUGACA-5'<br>Target: 5'-GCATATCTAATAAGATAGCCTTACTGT-3' | (SEQ ID NO: 1965)<br>(SEQ ID NO: 390)<br>(SEQ ID NO: 705) |
| MCL1-1193 | 5'-CAUAUCUAAUAAGAUAGCCUUACUGUA-3'<br>3'-GUAUAGAUUAUUCUAUCGGAAUGACAU-5'<br>Target: 5'-CATATCTAATAAGATAGCCTTACTGTA-3' | (SEQ ID NO: 1966)<br>(SEQ ID NO: 391)<br>(SEQ ID NO: 706) |
| MCL1-1207 | 5'-UAGCCUUACUGUAAGUGCAAUAGUUGA-3'<br>3'-AUCGGAAUGACAUUCACGUUAUCAACU-5'<br>Target: 5'-TAGCCTTACTGTAAGTGCAATAGTTGA-3' | (SEQ ID NO: 1967)<br>(SEQ ID NO: 392)<br>(SEQ ID NO: 707) |
| MCL1-1276 | 5'-UUGGACUCCAAGCUGUAACUUCCUAGA-3'<br>3'-AACCUGAGGUUCGACAUUGAAGGAUCU-5'<br>Target: 5'-TTGGACTCCAAGCTGTAACTTCCTAGA-3' | (SEQ ID NO: 1968)<br>(SEQ ID NO: 393)<br>(SEQ ID NO: 708) |
| MCL1-1293 | 5'-ACUUCCUAGAGUUGCACCCUAGCAACC-3'<br>3'-UGAAGGAUCUCAACGUGGGAUCGUUGG-5'<br>Target: 5'-ACTTCCTAGAGTTGCACCCTAGCAACC-3' | (SEQ ID NO: 1969)<br>(SEQ ID NO: 394)<br>(SEQ ID NO: 709) |
| MCL1-1329 | 5'-AAGCAAGUGGCAAGAGGAUUAUGGCUA-3'<br>3'-UUCGUUCACCGUUCUCCUAAUACCGAU-5'<br>Target: 5'-AAGCAAGTGGCAAGAGGATTATGGCTA-3' | (SEQ ID NO: 1970)<br>(SEQ ID NO: 395)<br>(SEQ ID NO: 710) |
| MCL1-1334 | 5'-AGUGGCAAGAGGAUUAUGGCUAACAAG-3'<br>3'-UCACCGUUCUCCUAAUACCGAUUGUUC-5'<br>Target: 5'-AGTGGCAAGAGGATTATGGCTAACAAG-3' | (SEQ ID NO: 1971)<br>(SEQ ID NO: 396)<br>(SEQ ID NO: 711) |
| MCL1-1335 | 5'-GUGGCAAGAGGAUUAUGGCUAACAAGA-3'<br>3'-CACCGUUCUCCUAAUACCGAUUGUUCU-5'<br>Target: 5'-GTGGCAAGAGGATTATGGCTAACAAGA-3' | (SEQ ID NO: 1972)<br>(SEQ ID NO: 397)<br>(SEQ ID NO: 712) |
| MCL1-1340 | 5'-AAGAGGAUUAUGGCUAACAAGAAUAAA-3'<br>3'-UUCUCCUAAUACCGAUUGUUCUUAUUU-5'<br>Target: 5'-AAGAGGATTATGGCTAACAAGAATAAA-3' | (SEQ ID NO: 1973)<br>(SEQ ID NO: 398)<br>(SEQ ID NO: 713) |
| MCL1-1348 | 5'-UAUGGCUAACAAGAAUAAAUACAUGGG-3'<br>3'-AUACCGAUUGUUCUUAUUUAUGUACCC-5'<br>Target: 5'-TATGGCTAACAAGAATAAATACATGGG-3' | (SEQ ID NO: 1974)<br>(SEQ ID NO: 399)<br>(SEQ ID NO: 714) |
| MCL1-1349 | 5'-AUGGCUAACAAGAAUAAAUACAUGGGA-3'<br>3'-UACCGAUUGUUCUUAUUUAUGUACCCU-5'<br>Target: 5'-ATGGCTAACAAGAATAAATACATGGGA-3' | (SEQ ID NO: 1975)<br>(SEQ ID NO: 400)<br>(SEQ ID NO: 715) |

TABLE 9-continued

Selected Human Anti-MCL1 "Blunt/Blunt" DsiRNAs

|  |  |  |
|---|---|---|
|  | 5'-UGGCUAACAAGAAUAAAUACAUGGGAA-3' | (SEQ ID NO: 1976) |
|  | 3'-ACCGAUUGUUCUUAUUUAUGUACCCUU-5' | (SEQ ID NO: 401) |
| MCL1-1350 Target: | 5'-TGGCTAACAAGAATAAATACATGGGAA-3' | (SEQ ID NO: 716) |
|  | 5'-GGCUAACAAGAAUAAAUACAUGGGAAG-3' | (SEQ ID NO: 1977) |
|  | 3'-CCGAUUGUUCUUAUUUAUGUACCCUUC-5' | (SEQ ID NO: 402) |
| MCL1-1351 Target: | 5'-GGCTAACAAGAATAAATACATGGGAAG-3' | (SEQ ID NO: 717) |
|  | 5'-GCUAACAAGAAUAAAUACAUGGGAAGA-3' | (SEQ ID NO: 1978) |
|  | 3'-CGAUUGUUCUUAUUUAUGUACCCUUCU-5' | (SEQ ID NO: 403) |
| MCL1-1352 Target: | 5'-GCTAACAAGAATAAATACATGGGAAGA-3' | (SEQ ID NO: 718) |
|  | 5'-CUAACAAGAAUAAAUACAUGGGAAGAG-3' | (SEQ ID NO: 1979) |
|  | 3'-GAUUGUUCUUAUUUAUGUACCCUUCUC-5' | (SEQ ID NO: 404) |
| MCL1-1353 Target: | 5'-CTAACAAGAATAAATACATGGGAAGAG-3' | (SEQ ID NO: 719) |
|  | 5'-UAACAAGAAUAAAUACAUGGGAAGAGU-3' | (SEQ ID NO: 1980) |
|  | 3'-AUUGUUCUUAUUUAUGUACCCUUCUCA-5' | (SEQ ID NO: 405) |
| MCL1-1354 Target: | 5'-TAACAAGAATAAATACATGGGAAGAGT-3' | (SEQ ID NO: 720) |
|  | 5'-AACAAGAAUAAAUACAUGGGAAGAGUG-3' | (SEQ ID NO: 1981) |
|  | 3'-UUGUUCUUAUUUAUGUACCCUUCUCAC-5' | (SEQ ID NO: 406) |
| MCL1-1355 Target: | 5'-AACAAGAATAAATACATGGGAAGAGTG-3' | (SEQ ID NO: 721) |
|  | 5'-ACAAGAAUAAAUACAUGGGAAGAGUGC-3' | (SEQ ID NO: 1982) |
|  | 3'-UGUUCUUAUUUAUGUACCCUUCUCACG-5' | (SEQ ID NO: 407) |
| MCL1-1356 Target: | 5'-ACAAGAATAAATACATGGGAAGAGTGC-3' | (SEQ ID NO: 722) |
|  | 5'-CAAGAAUAAAUACAUGGGAAGAGUGCU-3' | (SEQ ID NO: 1983) |
|  | 3'-GUUCUUAUUUAUGUACCCUUCUCACGA-5' | (SEQ ID NO: 408) |
| MCL1-1357 Target: | 5'-CAAGAATAAATACATGGGAAGAGTGCT-3' | (SEQ ID NO: 723) |
|  | 5'-CCCAUUGAUUGAAGAGUCACUGUCUGA-3' | (SEQ ID NO: 1984) |
|  | 3'-GGGUAACUAACUUCUCAGUGACAGACU-5' | (SEQ ID NO: 409) |
| MCL1-1385 Target: | 5'-CCCATTGATTGAAGAGTCACTGTCTGA-3' | (SEQ ID NO: 724) |
|  | 5'-CACUGUCUGAAAGAAGCAAAGUUCAGU-3' | (SEQ ID NO: 1985) |
|  | 3'-GUGACAGACUUUCUUCGUUUCAAGUCA-5' | (SEQ ID NO: 410) |
| MCL1-1402 Target: | 5'-CACTGTCTGAAAGAAGCAAAGTTCAGT-3' | (SEQ ID NO: 725) |
|  | 5'-AAACAAACUUUGUUUGGGAAGCUAUGG-3' | (SEQ ID NO: 1986) |
|  | 3'-UUUGUUUGAAACAAACCCUUCGAUACC-5' | (SEQ ID NO: 411) |
| MCL1-1438 Target: | 5'-AAACAAACTTTGTTTGGGAAGCTATGG-3' | (SEQ ID NO: 726) |
|  | 5'-GGAGGACUUUUAGAUUUAGUGAAGAUG-3' | (SEQ ID NO: 1987) |
|  | 3'-CCUCCUGAAAAUCUAAAUCACUUCUAC-5' | (SEQ ID NO: 412) |
| MCL1-1466 Target: | 5'-GGAGGACTTTTAGATTTAGTGAAGATG-3' | (SEQ ID NO: 727) |
|  | 5'-GAAGAUGGUAGGGUGGAAAGACUUAAU-3' | (SEQ ID NO: 1988) |
|  | 3'-CUUCUACCAUCCCACCUUUCUGAAUUA-5' | (SEQ ID NO: 413) |
| MCL1-1486 Target: | 5'-GAAGATGGTAGGGTGGAAAGACTTAAT-3' | (SEQ ID NO: 728) |
|  | 5'-UCCUUGUUGAGAACAGGAAAGUGGCCA-3' | (SEQ ID NO: 1989) |
|  | 3'-AGGAACAACUCUUGUCCUUUCACCGGU-5' | (SEQ ID NO: 414) |
| MCL1-1514 Target: | 5'-TCCTTGTTGAGAACAGGAAAGTGGCCA-3' | (SEQ ID NO: 729) |
|  | 5'-UAGCCAGGCAAGUCAUAGAAUUGAUUA-3' | (SEQ ID NO: 1990) |
|  | 3'-AUCGGUCCGUUCAGUAUCUUAACUAAU-5' | (SEQ ID NO: 415) |
| MCL1-1542 Target: | 5'-TAGCCAGGCAAGTCATAGAATTGATTA-3' | (SEQ ID NO: 730) |
|  | 5'-CCAGGCAAGUCAUAGAAUUGAUUACCC-3' | (SEQ ID NO: 1991) |
|  | 3'-GGUCCGUUCAGUAUCUUAACUAAUGGG-5' | (SEQ ID NO: 416) |
| MCL1-1545 Target: | 5'-CCAGGCAAGTCATAGAATTGATTACCC-3' | (SEQ ID NO: 731) |
|  | 5'-CAGGCAAGUCAUAGAAUUGAUUACCCG-3' | (SEQ ID NO: 1992) |
|  | 3'-GUCCGUUCAGUAUCUUAACUAAUGGGC-5' | (SEQ ID NO: 417) |
| MCL1-1546 Target: | 5'-CAGGCAAGTCATAGAATTGATTACCCG-3' | (SEQ ID NO: 732) |
|  | 5'-UACCCGCCGAAUUCAUUAAUUUACUGU-3' | (SEQ ID NO: 1993) |
|  | 3'-AUGGGCGGCUUAAGUAAUUAAAUGACA-5' | (SEQ ID NO: 418) |
| MCL1-1567 Target: | 5'-TACCCGCCGAATTCATTAATTTACTGT-3' | (SEQ ID NO: 733) |
|  | 5'-GCCGAAUUCAUUAAUUUACUGUAGUGU-3' | (SEQ ID NO: 1994) |
|  | 3'-CGGCUUAAGUAAUUAAAUGACAUCACA-5' | (SEQ ID NO: 419) |
| MCL1-1572 Target: | 5'-GCCGAATTCATTAATTTACTGTAGTGT-3' | (SEQ ID NO: 734) |

TABLE 9-continued

Selected Human Anti-MCL1 "Blunt/Blunt" DsiRNAs

| | | |
|---|---|---|
| MCL1-1593 Target: | 5'-UAGUGUUAAGAGAAGCACUAAGAAUGC-3'<br>3'-AUCACAAUUCUCUUCGUGAUUCUUACG-5'<br>5'-TAGTGTTAAGAGAAGCACTAAGAATGC-3' | (SEQ ID NO: 1995)<br>(SEQ ID NO: 420)<br>(SEQ ID NO: 735) |
| MCL1-1604 Target: | 5'-GAAGCACUAAGAAUGCCAGUGACCUGU-3'<br>3'-CUUCGUGAUUCUUACGGUCACUGGACA-5'<br>5'-GAAGCACTAAGAATGCCAGTGACCTGT-3' | (SEQ ID NO: 1996)<br>(SEQ ID NO: 421)<br>(SEQ ID NO: 736) |
| MCL1-1640 Target: | 5'-ACAAGUAAUAGAACUAUGACUGUAAGC-3'<br>3'-UGUUCAUUAUCUUGAUACUGACAUUCG-5'<br>5'-ACAAGTAATAGAACTATGACTGTAAGC-3' | (SEQ ID NO: 1997)<br>(SEQ ID NO: 422)<br>(SEQ ID NO: 737) |
| MCL1-1642 Target: | 5'-AAGUAAUAGAACUAUGACUGUAAGCCU-3'<br>3'-UUCAUUAUCUUGAUACUGACAUUCGGA-5'<br>5'-AAGTAATAGAACTATGACTGTAAGCCT-3' | (SEQ ID NO: 1998)<br>(SEQ ID NO: 423)<br>(SEQ ID NO: 738) |
| MCL1-1665 Target: | 5'-GCCUCAGUACUGUACAAGGGAAGCUUU-3'<br>3'-CGGAGUCAUGACAUGUUCCCUUCGAAA-5'<br>5'-GCCTCAGTACTGTACAAGGGAAGCTTT-3' | (SEQ ID NO: 1999)<br>(SEQ ID NO: 424)<br>(SEQ ID NO: 739) |
| MCL1-1711 Target: | 5'-UCCCAGUAUACUUCUUAGAAAGUCCAA-3'<br>3'-AGGGUCAUAUGAAGAAUCUUUCAGGUU-5'<br>5'-TCCCAGTATACTTCTTAGAAAGTCCAA-3' | (SEQ ID NO: 2000)<br>(SEQ ID NO: 425)<br>(SEQ ID NO: 740) |
| MCL1-1754 Target: | 5'-UACCUGUUAUACUUUGGCUUGGUUUCC-3'<br>3'-AUGGACAAUAUGAAACCGAACCAAAGG-5'<br>5'-TACCTGTTATACTTTGGCTTGGTTTCC-3' | (SEQ ID NO: 2001)<br>(SEQ ID NO: 426)<br>(SEQ ID NO: 741) |
| MCL1-1798 Target: | 5'-AGCCUAGUUUAUCACCAAUAAUACUUG-3'<br>3'-UCGGAUCAAAUAGUGGUUAUUAUGAAC-5'<br>5'-AGCCTAGTTTATCACCAATAATACTTG-3' | (SEQ ID NO: 2002)<br>(SEQ ID NO: 427)<br>(SEQ ID NO: 742) |
| MCL1-1808 Target: | 5'-AUCACCAAUAAUACUUGACGGAAGGCU-3'<br>3'-UAGUGGUUAUUAUGAACUGCCUUCCGA-5'<br>5'-ATCACCAATAATACTTGACGGAAGGCT-3' | (SEQ ID NO: 2003)<br>(SEQ ID NO: 428)<br>(SEQ ID NO: 743) |
| MCL1-1809 Target: | 5'-UCACCAAUAAUACUUGACGGAAGGCUC-3'<br>3'-AGUGGUUAUUAUGAACUGCCUUCCGAG-5'<br>5'-TCACCAATAATACTTGACGGAAGGCTC-3' | (SEQ ID NO: 2004)<br>(SEQ ID NO: 429)<br>(SEQ ID NO: 744) |
| MCL1-1810 Target: | 5'-CACCAAUAAUACUUGACGGAAGGCUCA-3'<br>3'-GUGGUUAUUAUGAACUGCCUUCCGAGU-5'<br>5'-CACCAATAATACTTGACGGAAGGCTCA-3' | (SEQ ID NO: 2005)<br>(SEQ ID NO: 430)<br>(SEQ ID NO: 745) |
| MCL1-1829 Target: | 5'-AAGGCUCAGUAAUUAGUUAUGAAUAUG-3'<br>3'-UUCCGAGUCAUUAAUCAAUACUUAUAC-5'<br>5'-AAGGCTCAGTAATTAGTTATGAATATG-3' | (SEQ ID NO: 2006)<br>(SEQ ID NO: 431)<br>(SEQ ID NO: 746) |
| MCL1-1833 Target: | 5'-CUCAGUAAUUAGUUAUGAAUAUGGAUA-3'<br>3'-GAGUCAUUAAUCAAUACUUAUACCUAU-5'<br>5'-CTCAGTAATTAGTTATGAATATGGATA-3' | (SEQ ID NO: 2007)<br>(SEQ ID NO: 432)<br>(SEQ ID NO: 747) |
| MCL1-1866 Target: | 5'-AUUCUUAAGACAGCUUGUAAAUGUAUU-3'<br>3'-UAAGAAUUCUGUCGAACAUUUACAUAA-5'<br>5'-ATTCTTAAGACAGCTTGTAAATGTATT-3' | (SEQ ID NO: 2008)<br>(SEQ ID NO: 433)<br>(SEQ ID NO: 748) |
| MCL1-1893 Target: | 5'-UGUAAAAAUUGUAUAUAUUUUUACAGA-3'<br>3'-ACAUUUUUAACAUAUAUAAAAAUGUCU-5'<br>5'-TGTAAAAATTGTATATATTTTTACAGA-3' | (SEQ ID NO: 2009)<br>(SEQ ID NO: 434)<br>(SEQ ID NO: 749) |
| MCL1-1912 Target: | 5'-UUUACAGAAAGUCUAUUUCUUUGAAAC-3'<br>3'-AAAUGUCUUUCAGAUAAAGAAACUUUG-5'<br>5'-TTTACAGAAAGTCTATTTCTTTGAAAC-3' | (SEQ ID NO: 2010)<br>(SEQ ID NO: 435)<br>(SEQ ID NO: 750) |
| MCL1-1913 Target: | 5'-UUACAGAAAGUCUAUUUCUUUGAAACG-3'<br>3'-AAUGUCUUUCAGAUAAAGAAACUUUGC-5'<br>5'-TTACAGAAAGTCTATTTCTTTGAAACG-3' | (SEQ ID NO: 2011)<br>(SEQ ID NO: 436)<br>(SEQ ID NO: 751) |
| MCL1-1914 Target: | 5'-UACAGAAAGUCUAUUUCUUUGAAACGA-3'<br>3'-AUGUCUUUCAGAUAAAGAAACUUUGCU-5'<br>5'-TACAGAAAGTCTATTTCTTTGAAACGA-3' | (SEQ ID NO: 2012)<br>(SEQ ID NO: 437)<br>(SEQ ID NO: 752) |
| MCL1-1915 Target: | 5'-ACAGAAAGUCUAUUUCUUUGAAACGAA-3'<br>3'-UGUCUUUCAGAUAAAGAAACUUUGCUU-5'<br>5'-ACAGAAAGTCTATTTCTTTGAAACGAA-3' | (SEQ ID NO: 2013)<br>(SEQ ID NO: 438)<br>(SEQ ID NO: 753) |

TABLE 9-continued

Selected Human Anti-MCL1 "Blunt/Blunt" DsiRNAs

```
                 5'-CAGAAAGUCUAUUUCUUUGAAACGAAG-3'  (SEQ ID NO: 2014)
                 3'-GUCUUUCAGAUAAAGAAACUUUGCUUC-5'  (SEQ ID NO: 439)
MCL1-1916 Target: 5'-CAGAAAGTCTATTTCTTTGAAACGAAG-3'  (SEQ ID NO: 754)

5'-AACGAAGGAAGUAUCGAAUUUACAUUA-3'  (SEQ ID NO: 2015)
                 3'-UUGCUUCCUUCAUAGCUUAAAUGUAAU-5'  (SEQ ID NO: 440)
MCL1-1936 Target: 5'-AACGAAGGAAGTATCGAATTTACATTA-3'  (SEQ ID NO: 755)

5'-AUCGAAUUUACAUUAGUUUUUUUCAUA-3'  (SEQ ID NO: 2016)
                 3'-UAGCUUAAAUGUAAUCAAAAAAAGUAU-5'  (SEQ ID NO: 441)
MCL1-1948 Target: 5'-ATCGAATTTACATTAGTTTTTTTCATA-3'  (SEQ ID NO: 756)

5'-GAACUUUGCAACUUCCGUAAUUAGGAA-3'  (SEQ ID NO: 2017)
                 3'-CUUGAAACGUUGAAGGCAUUAAUCCUU-5'  (SEQ ID NO: 442)
MCL1-1982 Target: 5'-GAACTTTGCAACTTCCGTAATTAGGAA-3'  (SEQ ID NO: 757)

5'-AGAGUGUAUACAGAACGAAUUGAUGUG-3'  (SEQ ID NO: 2018)
                 3'-UCUCACAUAUGUCUUGCUUAACUACAC-5'  (SEQ ID NO: 443)
MCL1-2057 Target: 5'-AGAGTGTATACAGAACGAATTGATGTG-3'  (SEQ ID NO: 758)

5'-GUGGAACAAAUCUGAUAACUAUGCAGG-3'  (SEQ ID NO: 2019)
                 3'-CACCUUGUUUAGACUAUUGAUACGUCC-5'  (SEQ ID NO: 444)
MCL1-2107 Target: 5'-GTGGAACAAATCTGATAACTATGCAGG-3'  (SEQ ID NO: 759)

5'-AAAUUUUCUUAUCUGAUUUUGGUAAGU-3'  (SEQ ID NO: 2020)
                 3'-UUUAAAAGAAUAGACUAAAACCAUUCA-5'  (SEQ ID NO: 445)
MCL1-2137 Target: 5'-AAATTTTCTTATCTGATTTTGGTAAGT-3'  (SEQ ID NO: 760)

5'-UAGGUUUUUCUUUGAAAACCUGGGAUU-3'  (SEQ ID NO: 2021)
                 3'-AUCCAAAAAGAAACUUUUGGACCCUAA-5'  (SEQ ID NO: 446)
MCL1-2174 Target: 5'-TAGGTTTTTCTTTGAAAACCTGGGATT-3'  (SEQ ID NO: 761)

5'-CUGGGAUUGAGAGGUUGAUGAAUGGAA-3'  (SEQ ID NO: 2022)
                 3'-GACCCUAACUCUCCAACUACUUACCUU-5'  (SEQ ID NO: 447)
MCL1-2193 Target: 5'-CTGGGATTGAGAGGTTGATGAATGGAA-3'  (SEQ ID NO: 762)

5'-UGAGAGGUUGAUGAAUGGAAAUUCUUU-3'  (SEQ ID NO: 2023)
                 3'-ACUCUCCAACUACUUACCUUUAAGAAA-5'  (SEQ ID NO: 448)
MCL1-2200 Target: 5'-TGAGAGGTTGATGAATGGAAATTCTTT-3'  (SEQ ID NO: 763)

5'-AGGUUGAUGAAUGGAAAUUCUUUCACU-3'  (SEQ ID NO: 2024)
                 3'-UCCAACUACUUACCUUUAAGAAAGUGA-5'  (SEQ ID NO: 449)
MCL1-2204 Target: 5'-AGGTTGATGAATGGAAATTCTTTCACT-3'  (SEQ ID NO: 764)

5'-UAUAUGCAAGUUUUCAAUAAUUAGGUC-3'  (SEQ ID NO: 2025)
                 3'-AUAUACGUUCAAAAGUUAUUAAUCCAG-5'  (SEQ ID NO: 450)
MCL1-2235 Target: 5'-TATATGCAAGTTTTCAATAATTAGGTC-3'  (SEQ ID NO: 765)

5'-AAGGUUACUGAUGACUUACAAAUAAUG-3'  (SEQ ID NO: 2026)
                 3'-UUCCAAUGACUACUGAAUGUUUAUUAC-5'  (SEQ ID NO: 451)
MCL1-2275 Target: 5'-AAGGTTACTGATGACTTACAAATAATG-3'  (SEQ ID NO: 766)

5'-AUUGGGCAAUACUCAUUUGAGUUCCUU-3'  (SEQ ID NO: 2027)
                 3'-UAACCCGUUAUGAGUAAACUCAAGGAA-5'  (SEQ ID NO: 452)
MCL1-2309 Target: 5'-ATTGGGCAATACTCATTTGAGTTCCTT-3'  (SEQ ID NO: 767)

5'-UUCCAUUUGACCUAAUUUAACUGGUGA-3'  (SEQ ID NO: 2028)
                 3'-AAGGUAAACUGGAUUAAAUUGACCACU-5'  (SEQ ID NO: 453)
MCL1-2334 Target: 5'-TTCCATTTGACCTAATTTAACTGGTGA-3'  (SEQ ID NO: 768)

5'-UUAAAGCUUUUACUAAAAGAUUUUCAG-3'  (SEQ ID NO: 2029)
                 3'-AAUUUCGAAAAUGAUUUUCUAAAAGUC-5'  (SEQ ID NO: 454)
MCL1-2389 Target: 5'-TTAAAGCTTTTACTAAAAGATTTTCAG-3'  (SEQ ID NO: 769)

5'-CAGGUGGAUGGAGAGACAUUUGAUCCC-3'  (SEQ ID NO: 2030)
                 3'-GUCCACCUACCUCUCUGUAAACUAGGG-5'  (SEQ ID NO: 455)
MCL1-2459 Target: 5'-CAGGTGGATGGAGAGACATTTGATCCC-3'  (SEQ ID NO: 770)

5'-UGCUUAAUAAAUUAUAAAAUGAUGGCU-3'  (SEQ ID NO: 2031)
                 3'-ACGAAUUAUUUAAUAUUUUACUACCGA-5'  (SEQ ID NO: 456)
MCL1-2491 Target: 5'-TGCTTAATAAATTATAAAATGATGGCT-3'  (SEQ ID NO: 771)

5'-UAACCAUGGUGCUAUUAUUAGGCUUGC-3'  (SEQ ID NO: 2032)
                 3'-AUUGGUACCACGAUAAUAAUCCGAACG-5'  (SEQ ID NO: 457)
MCL1-2536 Target: 5'-TAACCATGGTGCTATTATTAGGCTTGC-3'  (SEQ ID NO: 772)
```

TABLE 9-continued

Selected Human Anti-MCL1 "Blunt/Blunt" DsiRNAs

|  |  |  |
|---|---|---|
| MCL1-2581 Target: | 5'-UAAGCCUAGUAUGUCAAUAAAGCAAAU-3'<br>3'-AUUCGGAUCAUACAGUUAUUUCGUUUA-5'<br>5'-TAAGCCTAGTATGTCAATAAAGCAAAT-3' | (SEQ ID NO: 2033)<br>(SEQ ID NO: 458)<br>(SEQ ID NO: 773) |
| MCL1-2611 Target: | 5'-UACUGUUUUGUUUCUAUUAAUGAUUCC-3'<br>3'-AUGACAAAACAAAGAUAAUUACUAAGG-5'<br>5'-TACTGTTTTGTTTCTATTAATGATTCC-3' | (SEQ ID NO: 2034)<br>(SEQ ID NO: 459)<br>(SEQ ID NO: 774) |
| MCL1-2622 Target: | 5'-UUCUAUUAAUGAUUCCCAAACCUUGUU-3'<br>3'-AAGAUAAUUACUAAGGGUUUGGAACAA-5'<br>5'-TTCTATTAATGATTCCCAAACCTTGTT-3' | (SEQ ID NO: 2035)<br>(SEQ ID NO: 460)<br>(SEQ ID NO: 775) |
| MCL1-2643 Target: | 5'-CUUGUUGCAAGUUUUUGCAUUGGCAUC-3'<br>3'-GAACAACGUUCAAAAACGUAACCGUAG-5'<br>5'-CTTGTTGCAAGTTTTTGCATTGGCATC-3' | (SEQ ID NO: 2036)<br>(SEQ ID NO: 461)<br>(SEQ ID NO: 776) |
| MCL1-2671 Target: | 5'-UUGGAUUUCAGUCUUGAUGUUUGUUCU-3'<br>3'-AACCUAAAGUCAGAACUACAAACAAGA-5'<br>5'-TTGGATTTCAGTCTTGATGTTTGTTCT-3' | (SEQ ID NO: 2037)<br>(SEQ ID NO: 462)<br>(SEQ ID NO: 777) |
| MCL1-2725 Target: | 5'-CUUCCUUGAAAUUGCUGAUUGUUCUGC-3'<br>3'-GAAGGAACUUUAACGACUAACAAGACG-5'<br>5'-CTTCCTTGAAATTGCTGATTGTTCTGC-3' | (SEQ ID NO: 2038)<br>(SEQ ID NO: 463)<br>(SEQ ID NO: 778) |
| MCL1-2750 Target: | 5'-GCUCCCUCUACAGAUAUUUAUAUCAAU-3'<br>3'-CGAGGGAGAUGUCUAUAAAUAUAGUUA-5'<br>5'-GCTCCCTCTACAGATATTTATATCAAT-3' | (SEQ ID NO: 2039)<br>(SEQ ID NO: 464)<br>(SEQ ID NO: 779) |
| MCL1-2874 Target: | 5'-CCACCAAGAGUCCACAGACCUUUCAUC-3'<br>3'-GGUGGUUCUCAGGUGUCUGGAAAGUAG-5'<br>5'-CCACCAAGAGTCCACAGACCTTTCATC-3' | (SEQ ID NO: 2040)<br>(SEQ ID NO: 465)<br>(SEQ ID NO: 780) |
| MCL1-2875 Target: | 5'-CACCAAGAGUCCACAGACCUUUCAUCU-3'<br>3'-GUGGUUCUCAGGUGUCUGGAAAGUAGA-5'<br>5'-CACCAAGAGTCCACAGACCTTTCATCT-3' | (SEQ ID NO: 2041)<br>(SEQ ID NO: 466)<br>(SEQ ID NO: 781) |
| MCL1-2881 Target: | 5'-GAGUCCACAGACCUUUCAUCUUUCACG-3'<br>3'-CUCAGGUGUCUGGAAAGUAGAAAGUGC-5'<br>5'-GAGTCCACAGACCTTTCATCTTTCACG-3' | (SEQ ID NO: 2042)<br>(SEQ ID NO: 467)<br>(SEQ ID NO: 782) |
| MCL1-2882 Target: | 5'-AGUCCACAGACCUUUCAUCUUUCACGA-3'<br>3'-UCAGGUGUCUGGAAAGUAGAAAGUGCU-5'<br>5'-AGTCCACAGACCTTTCATCTTTCACGA-3' | (SEQ ID NO: 2043)<br>(SEQ ID NO: 468)<br>(SEQ ID NO: 783) |
| MCL1-2883 Target: | 5'-GUCCACAGACCUUUCAUCUUUCACGAA-3'<br>3'-CAGGUGUCUGGAAAGUAGAAAGUGCUU-5'<br>5'-GTCCACAGACCTTTCATCTTTCACGAA-3' | (SEQ ID NO: 2044)<br>(SEQ ID NO: 469)<br>(SEQ ID NO: 784) |
| MCL1-2884 Target: | 5'-UCCACAGACCUUUCAUCUUUCACGAAC-3'<br>3'-AGGUGUCUGGAAAGUAGAAAGUGCUUG-5'<br>5'-TCCACAGACCTTTCATCTTTCACGAAC-3' | (SEQ ID NO: 2045)<br>(SEQ ID NO: 470)<br>(SEQ ID NO: 785) |
| MCL1-2887 Target: | 5'-ACAGACCUUUCAUCUUUCACGAACUUG-3'<br>3'-UGUCUGGAAAGUAGAAAGUGCUUGAAC-5'<br>5'-ACAGACCTTTCATCTTTCACGAACTTG-3' | (SEQ ID NO: 2046)<br>(SEQ ID NO: 471)<br>(SEQ ID NO: 786) |
| MCL1-2890 Target: | 5'-GACCUUUCAUCUUUCACGAACUUGAUC-3'<br>3'-CUGGAAAGUAGAAAGUGCUUGAACUAG-5'<br>5'-GACCTTTCATCTTTCACGAACTTGATC-3' | (SEQ ID NO: 2047)<br>(SEQ ID NO: 472)<br>(SEQ ID NO: 787) |
| MCL1-2945 Target: | 5'-CUGUGACACUAACAGUCAUUGAGAGGU-3'<br>3'-GACACUGUGAUUGUCAGUAACUCUCCA-5'<br>5'-CTGTGACACTAACAGTCATTGAGAGGT-3' | (SEQ ID NO: 2048)<br>(SEQ ID NO: 473)<br>(SEQ ID NO: 788) |
| MCL1-2951 Target: | 5'-CACUAACAGUCAUUGAGAGGUGGGAGG-3'<br>3'-GUGAUUGUCAGUAACUCUCCACCCUCC-5'<br>5'-CACTAACAGTCATTGAGAGGTGGGAGG-3' | (SEQ ID NO: 2049)<br>(SEQ ID NO: 474)<br>(SEQ ID NO: 789) |
| MCL1-3114 Target: | 5'-UAGGAGUAUGCUCACUUAAAUUUACAG-3'<br>3'-AUCCUCAUACGAGUGAAUUUAAAUGUC-5'<br>5'-TAGGAGTATGCTCACTTAAATTTACAG-3' | (SEQ ID NO: 2050)<br>(SEQ ID NO: 475)<br>(SEQ ID NO: 790) |
| MCL1-3123 Target: | 5'-GCUCACUUAAAUUUACAGAAAGAGGUG-3'<br>3'-CGAGUGAAUUUAAAUGUCUUUCUCCAC-5'<br>5'-GCTCACTTAAATTTACAGAAAGAGGTG-3' | (SEQ ID NO: 2051)<br>(SEQ ID NO: 476)<br>(SEQ ID NO: 791) |

TABLE 9-continued

Selected Human Anti-MCL1 "Blunt/Blunt" DsiRNAs

|  |  |  |
|---|---|---|
| MCL1-3126 Target: | 5'-CACUUAAAUUUACAGAAAGAGGUGAGC-3'<br>3'-GUGAAUUUAAAUGUCUUUCUCCACUCG-5'<br>5'-CACTTAAATTTACAGAAAGAGGTGAGC-3' | (SEQ ID NO: 2052)<br>(SEQ ID NO: 477)<br>(SEQ ID NO: 792) |
| MCL1-3186 Target: | 5'-AAACUGAAGAAAGUGUCUAUAUUGGAA-3'<br>3'-UUUGACUUCUUUCACAGAUAUAACCUU-5'<br>5'-AAACTGAAGAAAGTGTCTATATTGGAA-3' | (SEQ ID NO: 2053)<br>(SEQ ID NO: 478)<br>(SEQ ID NO: 793) |
| MCL1-3207 Target: | 5'-UUGGAACUAGGGUCAUUUGAAAGCUUC-3'<br>3'-AACCUUGAUCCCAGUAAACUUUCGAAG-5'<br>5'-TTGGAACTAGGGTCATTTGAAAGCTTC-3' | (SEQ ID NO: 2054)<br>(SEQ ID NO: 479)<br>(SEQ ID NO: 794) |
| MCL1-3211 Target: | 5'-AACUAGGGUCAUUUGAAAGCUUCAGUC-3'<br>3'-UUGAUCCCAGUAAACUUUCGAAGUCAG-5'<br>5'-AACTAGGGTCATTTGAAAGCTTCAGTC-3' | (SEQ ID NO: 2055)<br>(SEQ ID NO: 480)<br>(SEQ ID NO: 795) |
| MCL1-3212 Target: | 5'-ACUAGGGUCAUUUGAAAGCUUCAGUCU-3'<br>3'-UGAUCCCAGUAAACUUUCGAAGUCAGA-5'<br>5'-ACTAGGGTCATTTGAAAGCTTCAGTCT-3' | (SEQ ID NO: 2056)<br>(SEQ ID NO: 481)<br>(SEQ ID NO: 796) |
| MCL1-3213 Target: | 5'-CUAGGGUCAUUUGAAAGCUUCAGUCUC-3'<br>3'-GAUCCCAGUAAACUUUCGAAGUCAGAG-5'<br>5'-CTAGGGTCATTTGAAAGCTTCAGTCTC-3' | (SEQ ID NO: 2057)<br>(SEQ ID NO: 482)<br>(SEQ ID NO: 797) |
| MCL1-3214 Target: | 5'-UAGGGUCAUUUGAAAGCUUCAGUCUCG-3'<br>3'-AUCCCAGUAAACUUUCGAAGUCAGAGC-5'<br>5'-TAGGGTCATTTGAAAGCTTCAGTCTCG-3' | (SEQ ID NO: 2058)<br>(SEQ ID NO: 483)<br>(SEQ ID NO: 798) |
| MCL1-3215 Target: | 5'-AGGGUCAUUUGAAAGCUUCAGUCUCGG-3'<br>3'-UCCCAGUAAACUUUCGAAGUCAGAGCC-5'<br>5'-AGGGTCATTTGAAAGCTTCAGTCTCGG-3' | (SEQ ID NO: 2059)<br>(SEQ ID NO: 484)<br>(SEQ ID NO: 799) |
| MCL1-3232 Target: | 5'-UCAGUCUCGGAACAUGACCUUUAGUCU-3'<br>3'-AGUCAGAGCCUUGUACUGGAAAUCAGA-5'<br>5'-TCAGTCTCGGAACATGACCTTTAGTCT-3' | (SEQ ID NO: 2060)<br>(SEQ ID NO: 485)<br>(SEQ ID NO: 800) |
| MCL1-3239 Target: | 5'-CGGAACAUGACCUUUAGUCUGUGGACU-3'<br>3'-GCCUUGUACUGGAAAUCAGACACCUGA-5'<br>5'-CGGAACATGACCTTTAGTCTGTGGACT-3' | (SEQ ID NO: 2061)<br>(SEQ ID NO: 486)<br>(SEQ ID NO: 801) |
| MCL1-3241 Target: | 5'-GAACAUGACCUUUAGUCUGUGGACUCC-3'<br>3'-CUUGUACUGGAAAUCAGACACCUGAGG-5'<br>5'-GAACATGACCTTTAGTCTGTGGACTCC-3' | (SEQ ID NO: 2062)<br>(SEQ ID NO: 487)<br>(SEQ ID NO: 802) |
| MCL1-3265 Target: | 5'-UCCAUUUAAAAAUAGGUAUGAAUAAGA-3'<br>3'-AGGUAAAUUUUUAUCCAUACUUAUUCU-5'<br>5'-TCCATTTAAAAATAGGTATGAATAAGA-3' | (SEQ ID NO: 2063)<br>(SEQ ID NO: 488)<br>(SEQ ID NO: 803) |
| MCL1-3277 Target: | 5'-UAGGUAUGAAUAAGAUGACUAAGAAUG-3'<br>3'-AUCCAUACUUAUUCUACUGAUUCUUAC-5'<br>5'-TAGGTATGAATAAGATGACTAAGAATG-3' | (SEQ ID NO: 2064)<br>(SEQ ID NO: 489)<br>(SEQ ID NO: 804) |
| MCL1-3326 Target: | 5'-CUGCCCAUCUCAGAGCCAUAAGGUCAU-3'<br>3'-GACGGGUAGAGUCUCGGUAUUCCAGUA-5'<br>5'-CTGCCCATCTCAGAGCCATAAGGTCAT-3' | (SEQ ID NO: 2065)<br>(SEQ ID NO: 490)<br>(SEQ ID NO: 805) |
| MCL1-3370 Target: | 5'-UUACCUAUGUAUUUAUCGUUCUUGAUC-3'<br>3'-AAUGGAUACAUAAAUAGCAAGAACUAG-5'<br>5'-TTACCTATGTATTTATCGTTCTTGATC-3' | (SEQ ID NO: 2066)<br>(SEQ ID NO: 491)<br>(SEQ ID NO: 806) |
| MCL1-3399 Target: | 5'-AAGCCGCUUAUUUAUAUCAUGUAUCUC-3'<br>3'-UUCGGCGAAUAAAUAUAGUACAUAGAG-5'<br>5'-AAGCCGCTTATTTATATCATGTATCTC-3' | (SEQ ID NO: 2067)<br>(SEQ ID NO: 492)<br>(SEQ ID NO: 807) |
| MCL1-3446 Target: | 5'-AUGUAGUUUUUAAUUAAUCUUAAGAUC-3'<br>3'-UACAUCAAAAAUUAAUUAGAAUUCUAG-5'<br>5'-ATGTAGTTTTTAATTAATCTTAAGATC-3' | (SEQ ID NO: 2068)<br>(SEQ ID NO: 493)<br>(SEQ ID NO: 808) |
| MCL1-3492 Target: | 5'-AGCCUGUCUGCCAAAUCCAGUGGAAAC-3'<br>3'-UCGGACAGACGGUUUAGGUCACCUUUG-5'<br>5'-AGCCTGTCTGCCAAATCCAGTGGAAAC-3' | (SEQ ID NO: 2069)<br>(SEQ ID NO: 494)<br>(SEQ ID NO: 809) |
| MCL1-3498 Target: | 5'-UCUGCCAAAUCCAGUGGAAACAAGUGC-3'<br>3'-AGACGGUUUAGGUCACCUUUGUUCACG-5'<br>5'-TCTGCCAAATCCAGTGGAAACAAGTGC-3' | (SEQ ID NO: 2070)<br>(SEQ ID NO: 495)<br>(SEQ ID NO: 810) |

TABLE 9-continued

Selected Human Anti-MCL1 "Blunt/Blunt" DsiRNAs

|  |  |  |
|---|---|---|
| MCL1-3508 | 5'-CCAGUGGAAACAAGUGCAUAGAUGUGA-3'<br>3'-GGUCACCUUUGUUCACGUAUCUACACU-5'<br>Target: 5'-CCAGTGGAAACAAGTGCATAGATGTGA-3' | (SEQ ID NO: 2071)<br>(SEQ ID NO: 496)<br>(SEQ ID NO: 811) |
| MCL1-3511 | 5'-GUGGAAACAAGUGCAUAGAUGUGAAUU-3'<br>3'-CACCUUUGUUCACGUAUCUACACUUAA-5'<br>Target: 5'-GTGGAAACAAGTGCATAGATGTGAATT-3' | (SEQ ID NO: 2072)<br>(SEQ ID NO: 497)<br>(SEQ ID NO: 812) |
| MCL1-3552 | 5'-CCACUUCCCAAUUCAUUAGGUAUGACU-3'<br>3'-GGUGAAGGGUUAAGUAAUCCAUACUGA-5'<br>Target: 5'-CCACTTCCCAATTCATTAGGTATGACT-3' | (SEQ ID NO: 2073)<br>(SEQ ID NO: 498)<br>(SEQ ID NO: 813) |
| MCL1-3568 | 5'-UAGGUAUGACUGUGGAAAUACAGACAA-3'<br>3'-AUCCAUACUGACACCUUUAUGUCUGUU-5'<br>Target: 5'-TAGGTATGACTGTGGAAATACAGACAA-3' | (SEQ ID NO: 2074)<br>(SEQ ID NO: 499)<br>(SEQ ID NO: 814) |
| MCL1-3573 | 5'-AUGACUGUGGAAAUACAGACAAGGAUC-3'<br>3'-UACUGACACCUUUAUGUCUGUUCCUAG-5'<br>Target: 5'-ATGACTGTGGAAATACAGACAAGGATC-3' | (SEQ ID NO: 2075)<br>(SEQ ID NO: 500)<br>(SEQ ID NO: 815) |
| MCL1-3574 | 5'-UGACUGUGGAAAUACAGACAAGGAUCU-3'<br>3'-ACUGACACCUUUAUGUCUGUUCCUAGA-5'<br>Target: 5'-TGACTGTGGAAATACAGACAAGGATCT-3' | (SEQ ID NO: 2076)<br>(SEQ ID NO: 501)<br>(SEQ ID NO: 816) |
| MCL1-3576 | 5'-ACUGUGGAAAUACAGACAAGGAUCUUA-3'<br>3'-UGACACCUUUAUGUCUGUUCCUAGAAU-5'<br>Target: 5'-ACTGTGGAAATACAGACAAGGATCTTA-3' | (SEQ ID NO: 2077)<br>(SEQ ID NO: 502)<br>(SEQ ID NO: 817) |
| MCL1-3577 | 5'-CUGUGGAAAUACAGACAAGGAUCUUAG-3'<br>3'-GACACCUUUAUGUCUGUUCCUAGAAUC-5'<br>Target: 5'-CTGTGGAAATACAGACAAGGATCTTAG-3' | (SEQ ID NO: 2078)<br>(SEQ ID NO: 503)<br>(SEQ ID NO: 818) |
| MCL1-3578 | 5'-UGUGGAAAUACAGACAAGGAUCUUAGU-3'<br>3'-ACACCUUUAUGUCUGUUCCUAGAAUCA-5'<br>Target: 5'-TGTGGAAATACAGACAAGGATCTTAGT-3' | (SEQ ID NO: 2079)<br>(SEQ ID NO: 504)<br>(SEQ ID NO: 819) |
| MCL1-3579 | 5'-GUGGAAAUACAGACAAGGAUCUUAGUU-3'<br>3'-CACCUUUAUGUCUGUUCCUAGAAUCAA-5'<br>Target: 5'-GTGGAAATACAGACAAGGATCTTAGTT-3' | (SEQ ID NO: 2080)<br>(SEQ ID NO: 505)<br>(SEQ ID NO: 820) |
| MCL1-3580 | 5'-UGGAAAUACAGACAAGGAUCUUAGUUG-3'<br>3'-ACCUUUAUGUCUGUUCCUAGAAUCAAC-5'<br>Target: 5'-TGGAAATACAGACAAGGATCTTAGTTG-3' | (SEQ ID NO: 2081)<br>(SEQ ID NO: 506)<br>(SEQ ID NO: 821) |
| MCL1-3690 | 5'-GAGGAGGAGGCAGGUGGUCUAAGUGCU-3'<br>3'-CUCCUCCUCCGUCCACCAGAUUCACGA-5'<br>Target: 5'-GAGGAGGAGGCAGGTGGTCTAAGTGCT-3' | (SEQ ID NO: 2082)<br>(SEQ ID NO: 507)<br>(SEQ ID NO: 822) |
| MCL1-3720 | 5'-UGGCUACGUAGUUCGGGCAAAUCCUCC-3'<br>3'-ACCGAUGCAUCAAGCCCGUUUAGGAGG-5'<br>Target: 5'-TGGCTACGTAGTTCGGGCAAATCCTCC-3' | (SEQ ID NO: 2083)<br>(SEQ ID NO: 508)<br>(SEQ ID NO: 823) |
| MCL1-3758 | 5'-GGAGGAUUUGCUUAGAAGGAUGGCGCU-3'<br>3'-CCUCCUAAACGAAUCUUCCUACCGCGA-5'<br>Target: 5'-GGAGGATTTGCTTAGAAGGATGGCGCT-3' | (SEQ ID NO: 2084)<br>(SEQ ID NO: 509)<br>(SEQ ID NO: 824) |
| MCL1-3759 | 5'-GAGGAUUUGCUUAGAAGGAUGGCGCUC-3'<br>3'-CUCCUAAACGAAUCUUCCUACCGCGAG-5'<br>Target: 5'-GAGGATTTGCTTAGAAGGATGGCGCTC-3' | (SEQ ID NO: 2085)<br>(SEQ ID NO: 510)<br>(SEQ ID NO: 825) |
| MCL1-3844 | 5'-GUCCUCUAGUGUUUCAUGUACAUUCUG-3'<br>3'-CAGGAGAUCACAAAGUACAUGUAAGAC-5'<br>Target: 5'-GTCCTCTAGTGTTTCATGTACATTCTG-3' | (SEQ ID NO: 2086)<br>(SEQ ID NO: 511)<br>(SEQ ID NO: 826) |
| MCL1-3879 | 5'-GAACACCUUGGUUCUGGUUAAACAGCU-3'<br>3'-CUUGUGGAACCAAGACCAAUUUGUCGA-5'<br>Target: 5'-GAACACCTTGGTTCTGGTTAAACAGCT-3' | (SEQ ID NO: 2087)<br>(SEQ ID NO: 512)<br>(SEQ ID NO: 827) |
| MCL1-3915 | 5'-AUAGCUGUGCCAGGAAGGGUUAGGACC-3'<br>3'-UAUCGACACGGUCCUUCCCAAUCCUGG-5'<br>Target: 5'-ATAGCTGTGCCAGGAAGGGTTAGGACC-3' | (SEQ ID NO: 2088)<br>(SEQ ID NO: 513)<br>(SEQ ID NO: 828) |
| MCL1-3924 | 5'-CCAGGAAGGGUUAGGACCAACUACAAA-3'<br>3'-GGUCCUUCCCAAUCCUGGUUGAUGUUU-5'<br>Target: 5'-CCAGGAAGGGTTAGGACCAACTACAAA-3' | (SEQ ID NO: 2089)<br>(SEQ ID NO: 514)<br>(SEQ ID NO: 829) |

TABLE 9-continued

Selected Human Anti-MCL1 "Blunt/Blunt" DsiRNAs

|  |  |  |
|---|---|---|
| MCL1-3930 Target: | 5'-AGGGUUAGGACCAACUACAAAUUAAUG-3'<br>3'-UCCCAAUCCUGGUUGAUGUUUAAUUAC-5'<br>5'-AGGGTTAGGACCAACTACAAATTAATG-3' | (SEQ ID NO: 2090)<br>(SEQ ID NO: 515)<br>(SEQ ID NO: 830) |
| MCL1-872 Target: | 5'-ACGAAGACGAUGUGAAAUCGUUGUCUC-3'<br>3'-UGCUUCUGCUACACUUUAGCAACAGAG-5'<br>5'-ACGAAGACGATGTGAAATCGTTGTCTC-3' | (SEQ ID NO: 2782)<br>(SEQ ID NO: 2302)<br>(SEQ ID NO: 2398) |
| MCL1-941 Target: | 5'-GCAGGAUUGUGACUCUCAUUUCUUUUG-3'<br>3'-CGUCCUAACACUGAGAGUAAAGAAAAC-5'<br>5'-GCAGGATTGTGACTCTCATTTCTTTTG-3' | (SEQ ID NO: 2783)<br>(SEQ ID NO: 2303)<br>(SEQ ID NO: 2399) |
| MCL1-943 Target: | 5'-AGGAUUGUGACUCUCAUUUCUUUUGGU-3'<br>3'-UCCUAACACUGAGAGUAAAGAAAACCA-5'<br>5'-AGGATTGTGACTCTCATTTCTTTTGGT-3' | (SEQ ID NO: 2784)<br>(SEQ ID NO: 2304)<br>(SEQ ID NO: 2400) |
| MCL1-965 Target: | 5'-UUGGUGCCUUUGUGGCUAAACACUUGA-3'<br>3'-AACCACGGAAACACCGAUUUGUGAACU-5'<br>5'-TTGGTGCCTTTGTGGCTAAACACTTGA-3' | (SEQ ID NO: 2785)<br>(SEQ ID NO: 2305)<br>(SEQ ID NO: 2401) |
| MCL1-968 Target: | 5'-GUGCCUUUGUGGCUAAACACUUGAAGA-3'<br>3'-CACGGAAACACCGAUUUGUGAACUUCU-5'<br>5'-GTGCCTTTGTGGCTAAACACTTGAAGA-3' | (SEQ ID NO: 2786)<br>(SEQ ID NO: 2306)<br>(SEQ ID NO: 2402) |
| MCL1-1095 Target: | 5'-UGGGUUUGUGGAGUUCUUCCAUGUAGA-3'<br>3'-ACCCAAACACCUCAAGAAGGUACAUCU-5'<br>5'-TGGGTTTGTGGAGTTCTTCCATGTAGA-3' | (SEQ ID NO: 2787)<br>(SEQ ID NO: 2307)<br>(SEQ ID NO: 2403) |
| MCL1-1308 Target: | 5'-ACCCUAGCAACCUAGCCAGAAAAGCAA-3'<br>3'-UGGGAUCGUUGGAUCGGUCUUUUCGUU-5'<br>5'-ACCCTAGCAACCTAGCCAGAAAAGCAA-3' | (SEQ ID NO: 2788)<br>(SEQ ID NO: 2308)<br>(SEQ ID NO: 2404) |
| MCL1-1312 Target: | 5'-UAGCAACCUAGCCAGAAAAGCAAGUGG-3'<br>3'-AUCGUUGGAUCGGUCUUUUCGUUCACC-5'<br>5'-TAGCAACCTAGCCAGAAAAGCAAGTGG-3' | (SEQ ID NO: 2789)<br>(SEQ ID NO: 2309)<br>(SEQ ID NO: 2405) |
| MCL1-1325 Target: | 5'-AGAAAAGCAAGUGGCAAGAGGAUUAUG-3'<br>3'-UCUUUUCGUUCACCGUUCUCCUAAUAC-5'<br>5'-AGAAAAGCAAGTGGCAAGAGGATTATG-3' | (SEQ ID NO: 2790)<br>(SEQ ID NO: 2310)<br>(SEQ ID NO: 2406) |
| MCL1-1338 Target: | 5'-GCAAGAGGAUUAUGGCUAACAAGAAUA-3'<br>3'-CGUUCUCCUAAUACCGAUUGUUCUUAU-5'<br>5'-GCAAGAGGATTATGGCTAACAAGAATA-3' | (SEQ ID NO: 2791)<br>(SEQ ID NO: 2311)<br>(SEQ ID NO: 2407) |
| MCL1-1342 Target: | 5'-GAGGAUUAUGGCUAACAAGAAUAAAUA-3'<br>3'-CUCCUAAUACCGAUUGUUCUUAUUUAU-5'<br>5'-GAGGATTATGGCTAACAAGAATAAATA-3' | (SEQ ID NO: 2792)<br>(SEQ ID NO: 2312)<br>(SEQ ID NO: 2408) |
| MCL1-1344 Target: | 5'-GGAUUAUGGCUAACAAGAAUAAAUACA-3'<br>3'-CCUAAUACCGAUUGUUCUUAUUUAUGU-5'<br>5'-GGATTATGGCTAACAAGAATAAATACA-3' | (SEQ ID NO: 2793)<br>(SEQ ID NO: 2313)<br>(SEQ ID NO: 2409) |
| MCL1-1349 Target: | 5'-AUGGCUAACAAGAAUAAAUACAUGGGA-3'<br>3'-UACCGAUUGUUCUUAUUUAUGUACCCU-5'<br>5'-ATGGCTAACAAGAATAAATACATGGGA-3' | (SEQ ID NO: 2794)<br>(SEQ ID NO: 2314)<br>(SEQ ID NO: 2410) |
| MCL1-1393 Target: | 5'-UUGAAGAGUCACUGUCUGAAAGAAGCA-3'<br>3'-AACUUCUCAGUGACAGACUUUCUUCGU-5'<br>5'-TTGAAGAGTCACTGTCTGAAAGAAGCA-3' | (SEQ ID NO: 2795)<br>(SEQ ID NO: 2315)<br>(SEQ ID NO: 2411) |
| MCL1-1397 Target: | 5'-AGAGUCACUGUCUGAAAGAAGCAAAGU-3'<br>3'-UCUCAGUGACAGACUUUCUUCGUUUCA-5'<br>5'-AGAGTCACTGTCTGAAAGAAGCAAAGT-3' | (SEQ ID NO: 2796)<br>(SEQ ID NO: 2316)<br>(SEQ ID NO: 2412) |
| MCL1-1400 Target: | 5'-GUCACUGUCUGAAAGAAGCAAAGUUCA-3'<br>3'-CAGUGACAGACUUUCUUCGUUUCAAGU-5'<br>5'-GTCACTGTCTGAAAGAAGCAAAGTTCA-3' | (SEQ ID NO: 2797)<br>(SEQ ID NO: 2317)<br>(SEQ ID NO: 2413) |
| MCL1-1539 Target: | 5'-CAGUAGCCAGGCAAGUCAUAGAAUUGA-3'<br>3'-GUCAUCGGUCCGUUCAGUAUCUUAACU-5'<br>5'-CAGTAGCCAGGCAAGTCATAGAATTGA-3' | (SEQ ID NO: 2798)<br>(SEQ ID NO: 2318)<br>(SEQ ID NO: 2414) |
| MCL1-1544 Target: | 5'-GCCAGGCAAGUCAUAGAAUUGAUUACC-3'<br>3'-CGGUCCGUUCAGUAUCUUAACUAAUGG-5'<br>5'-GCCAGGCAAGTCATAGAATTGATTACC-3' | (SEQ ID NO: 2799)<br>(SEQ ID NO: 2319)<br>(SEQ ID NO: 2415) |

TABLE 9-continued

Selected Human Anti-MCL1 "Blunt/Blunt" DsiRNAs

```
                  5'-UUGAUUACCCGCCGAAUUCAUUAAUUU-3'  (SEQ ID NO: 2800)
                  3'-AACUAAUGGGCGGCUUAAGUAAUUAAA-5'  (SEQ ID NO: 2320)
MCL1-1562 Target: 5'-TTGATTACCCGCCGAATTCATTAATTT-3'  (SEQ ID NO: 2416)

5'-ACCCGCCGAAUUCAUUAAUUUACUGUA-3'  (SEQ ID NO: 2801)
                  3'-UGGGCGGCUUAAGUAAUUAAAUGACAU-5'  (SEQ ID NO: 2321)
MCL1-1568 Target: 5'-ACCCGCCGAATTCATTAATTTACTGTA-3'  (SEQ ID NO: 2417)

5'-CCGAAUUCAUUAAUUUACUGUAGUGUU-3'  (SEQ ID NO: 2802)
                  3'-GGCUUAAGUAAUUAAAUGACAUCACAA-5'  (SEQ ID NO: 2322)
MCL1-1573 Target: 5'-CCGAATTCATTAATTTACTGTAGTGTT-3'  (SEQ ID NO: 2418)

5'-GUCCAAGUGUUCAGGACUUUUAUACCU-3'  (SEQ ID NO: 2803)
                  3'-CAGGUUCACAAGUCCUGAAAAUAUGGA-5'  (SEQ ID NO: 2323)
MCL1-1732 Target: 5'-GTCCAAGTGTTCAGGACTTTTATACCT-3'  (SEQ ID NO: 2419)

5'-CCAAGUGUUCAGGACUUUUAUACCUGU-3'  (SEQ ID NO: 2804)
                  3'-GGUUCACAAGUCCUGAAAAUAUGGACA-5'  (SEQ ID NO: 2324)
MCL1-1734 Target: 5'-CCAAGTGTTCAGGACTTTTATACCTGT-3'  (SEQ ID NO: 2420)

5'-GUUCAGGACUUUUAUACCUGUUAUACU-3'  (SEQ ID NO: 2805)
                  3'-CAAGUCCUGAAAAUAUGGACAAUAUGA-5'  (SEQ ID NO: 2325)
MCL1-1740 Target: 5'-GTTCAGGACTTTTATACCTGTTATACT-3'  (SEQ ID NO: 2421)

5'-UCAGGACUUUUAUACCUGUUAUACUUU-3'  (SEQ ID NO: 2806)
                  3'-AGUCCUGAAAAUAUGGACAAUAUGAAA-5'  (SEQ ID NO: 2326)
MCL1-1742 Target: 5'-TCAGGACTTTTATACCTGTTATACTTT-3'  (SEQ ID NO: 2422)

5'-GACUUUUAUACCUGUUAUACUUUGGCU-3'  (SEQ ID NO: 2807)
                  3'-CUGAAAAUAUGGACAAUAUGAAACCGA-5'  (SEQ ID NO: 2327)
MCL1-1746 Target: 5'-GACTTTTATACCTGTTATACTTTGGCT-3'  (SEQ ID NO: 2423)

5'-GCCUAGUUUAUCACCAAUAAUACUUGA-3'  (SEQ ID NO: 2808)
                  3'-CGGAUCAAAUAGUGGUUAUUAUGAACU-5'  (SEQ ID NO: 2328)
MCL1-1799 Target: 5'-GCCTAGTTTATCACCAATAATACTTGA-3'  (SEQ ID NO: 2424)

5'-UUGACGGAAGGCUCAGUAAUUAGUUAU-3'  (SEQ ID NO: 2809)
                  3'-AACUGCCUUCCGAGUCAUUAAUCAAUA-5'  (SEQ ID NO: 2329)
MCL1-1822 Target: 5'-TTGACGGAAGGCTCAGTAATTAGTTAT-3'  (SEQ ID NO: 2425)

5'-GACGGAAGGCUCAGUAAUUAGUUAUGA-3'  (SEQ ID NO: 2810)
                  3'-CUGCCUUCCGAGUCAUUAAUCAAUACU-5'  (SEQ ID NO: 2330)
MCL1-1824 Target: 5'-GACGGAAGGCTCAGTAATTAGTTATGA-3'  (SEQ ID NO: 2426)

5'-CGGAAGGCUCAGUAAUUAGUUAUGAAU-3'  (SEQ ID NO: 2811)
                  3'-GCCUUCCGAGUCAUUAAUCAAUACUUA-5'  (SEQ ID NO: 2331)
MCL1-1826 Target: 5'-CGGAAGGCTCAGTAATTAGTTATGAAT-3'  (SEQ ID NO: 2427)

5'-GGCUCAGUAAUUAGUUAUGAAUAUGGA-3'  (SEQ ID NO: 2812)
                  3'-CCGAGUCAUUAAUCAAUACUUAUACCU-5'  (SEQ ID NO: 2332)
MCL1-1831 Target: 5'-GGCTCAGTAATTAGTTATGAATATGGA-3'  (SEQ ID NO: 2428)

5'-CUCAGUAAUUAGUUAUGAAUAUGGAUA-3'  (SEQ ID NO: 2813)
                  3'-GAGUCAUUAAUCAAUACUUAUACCUAU-5'  (SEQ ID NO: 2333)
MCL1-1833 Target: 5'-CTCAGTAATTAGTTATGAATATGGATA-3'  (SEQ ID NO: 2429)

5'-AAGACAGCUUGUAAAUGUAUUUGUAAA-3'  (SEQ ID NO: 2814)
                  3'-UUCUGUCGAACAUUUACAUAAACAUUU-5'  (SEQ ID NO: 2334)
MCL1-1872 Target: 5'-AAGACAGCTTGTAAATGTATTTGTAAA-3'  (SEQ ID NO: 2430)

5'-ACAGCUUGUAAAUGUAUUUGUAAAAAU-3'  (SEQ ID NO: 2815)
                  3'-UGUCGAACAUUUACAUAAACAUUUUUA-5'  (SEQ ID NO: 2335)
MCL1-1875 Target: 5'-ACAGCTTGTAAATGTATTTGTAAAAAT-3'  (SEQ ID NO: 2431)

5'-CAGAAAGUCUAUUUCUUUGAAACGAAG-3'  (SEQ ID NO: 2816)
                  3'-GUCUUUCAGAUAAAGAAACUUUGCUUC-5'  (SEQ ID NO: 2336)
MCL1-1916 Target: 5'-CAGAAAGTCTATTTCTTTGAAACGAAG-3'  (SEQ ID NO: 2432)

5'-AUCGAAUUUACAUUAGUUUUUUUCAUA-3'  (SEQ ID NO: 2817)
                  3'-UAGCUUAAAUGUAAUCAAAAAAAGUAU-5'  (SEQ ID NO: 2337)
MCL1-1948 Target: 5'-ATCGAATTTACATTAGTTTTTTTCATA-3'  (SEQ ID NO: 2433)

5'-UACAUUAGUUUUUUUCAUACCCUUUG-3'   (SEQ ID NO: 2818)
                  3'-AUGUAAUCAAAAAAAGUAUGGGAAAC-5'   (SEQ ID NO: 2338)
MCL1-1956 Target: 5'-TACATTAGTTTTTTTCATACCCTTTG-3'   (SEQ ID NO: 2434)
```

TABLE 9-continued

Selected Human Anti-MCL1 "Blunt/Blunt" DsiRNAs

| | | |
|---|---|---|
| | 5'-CAUUAGUUUUUUCAUACCCUUUUGAA-3' | (SEQ ID NO: 2819) |
| | 3'-GUAAUCAAAAAAGUAUGGGAAAACUU-5' | (SEQ ID NO: 2339) |
| MCL1-1958 Target: | 5'-CATTAGTTTTTTCATACCCTTTTGAA-3' | (SEQ ID NO: 2435) |
| | 5'-UUCAUACCCUUUUGAACUUUGCAACUU-3' | (SEQ ID NO: 2820) |
| | 3'-AAGUAUGGGAAAACUUGAAACGUUGAA-5' | (SEQ ID NO: 2340) |
| MCL1-1969 Target: | 5'-TTCATACCCTTTTGAACTTTGCAACTT-3' | (SEQ ID NO: 2436) |
| | 5'-AGCUUUUCUAUGCUAAACUUUGUUCUG-3' | (SEQ ID NO: 2821) |
| | 3'-UCGAAAAGAUACGAUUUGAAACAAGAC-5' | (SEQ ID NO: 2341) |
| MCL1-2021 Target: | 5'-AGCTTTTCTATGCTAAACTTTGTTCTG-3' | (SEQ ID NO: 2437) |
| | 5'-UGCUAAACUUUGUUCUGUUCAGUUCUA-3' | (SEQ ID NO: 2822) |
| | 3'-ACGAUUUGAAACAAGACAAGUCAAGAU-5' | (SEQ ID NO: 2342) |
| MCL1-2031 Target: | 5'-TGCTAAACTTTGTTCTGTTCAGTTCTA-3' | (SEQ ID NO: 2438) |
| | 5'-CUAAACUUUGUUCUGUUCAGUUCUAGA-3' | (SEQ ID NO: 2823) |
| | 3'-GAUUUGAAACAAGACAAGUCAAGAUCU-5' | (SEQ ID NO: 2343) |
| MCL1-2033 Target: | 5'-CTAAACTTTGTTCTGTTCAGTTCTAGA-3' | (SEQ ID NO: 2439) |
| | 5'-CUGUAUGCAGACUGGUUGUAGUGGAAC-3' | (SEQ ID NO: 2824) |
| | 3'-GACAUACGUCUGACCAACAUCACCUUG-5' | (SEQ ID NO: 2344) |
| MCL1-2087 Target: | 5'-CTGTATGCAGACTGGTTGTAGTGGAAC-3' | (SEQ ID NO: 2440) |
| | 5'-AUGCAGACUGGUUGUAGUGGAACAAAU-3' | (SEQ ID NO: 2825) |
| | 3'-UACGUCUGACCAACAUCACCUUGUUUA-5' | (SEQ ID NO: 2345) |
| MCL1-2091 Target: | 5'-ATGCAGACTGGTTGTAGTGGAACAAAT-3' | (SEQ ID NO: 2441) |
| | 5'-GUGGAACAAAUCUGAUAACUAUGCAGG-3' | (SEQ ID NO: 2826) |
| | 3'-CACCUUGUUUAGACUAUUGAUACGUCC-5' | (SEQ ID NO: 2346) |
| MCL1-2107 Target: | 5'-GTGGAACAAATCTGATAACTATGCAGG-3' | (SEQ ID NO: 2442) |
| | 5'-UUGAGAGGUUGAUGAAUGGAAAUUCUU-3' | (SEQ ID NO: 2827) |
| | 3'-AACUCUCCAACUACUUACCUUUAAGAA-5' | (SEQ ID NO: 2347) |
| MCL1-2199 Target: | 5'-TTGAGAGGTTGATGAATGGAAATTCTT-3' | (SEQ ID NO: 2443) |
| | 5'-GAAUGGAAAUUCUUUCACUUCAUUAUA-3' | (SEQ ID NO: 2828) |
| | 3'-CUUACCUUUAAGAAAGUGAAGUAAUAU-5' | (SEQ ID NO: 2348) |
| MCL1-2212 Target: | 5'-GAATGGAAATTCTTTCACTTCATTATA-3' | (SEQ ID NO: 2444) |
| | 5'-UGGAAAUUCUUUCACUUCAUUAUAUGC-3' | (SEQ ID NO: 2829) |
| | 3'-ACCUUUAAGAAAGUGAAGUAAUAUACG-5' | (SEQ ID NO: 2349) |
| MCL1-2215 Target: | 5'-TGGAAATTCTTTCACTTCATTATATGC-3' | (SEQ ID NO: 2445) |
| | 5'-GAAAUUCUUUCACUUCAUUAUAUGCAA-3' | (SEQ ID NO: 2830) |
| | 3'-CUUUAAGAAAGUGAAGUAAUAUACGUU-5' | (SEQ ID NO: 2350) |
| MCL1-2217 Target: | 5'-GAAATTCTTTCACTTCATTATATGCAA-3' | (SEQ ID NO: 2446) |
| | 5'-UUCACUUCAUUAUAUGCAAGUUUUCAA-3' | (SEQ ID NO: 2831) |
| | 3'-AAGUGAAGUAAUAUACGUUCAAAAGUU-5' | (SEQ ID NO: 2351) |
| MCL1-2225 Target: | 5'-TTCACTTCATTATATGCAAGTTTTCAA-3' | (SEQ ID NO: 2447) |
| | 5'-CACUUCAUUAUAUGCAAGUUUUCAAUA-3' | (SEQ ID NO: 2832) |
| | 3'-GUGAAGUAAUAUACGUUCAAAAGUUAU-5' | (SEQ ID NO: 2352) |
| MCL1-2227 Target: | 5'-CACTTCATTATATGCAAGTTTTCAATA-3' | (SEQ ID NO: 2448) |
| | 5'-UUCAUUAUAUGCAAGUUUUCAAUAAUU-3' | (SEQ ID NO: 2833) |
| | 3'-AAGUAAUAUACGUUCAAAAGUUAUUAA-5' | (SEQ ID NO: 2353) |
| MCL1-2230 Target: | 5'-TTCATTATATGCAAGTTTTCAATAATT-3' | (SEQ ID NO: 2449) |
| | 5'-CAUUAUAUGCAAGUUUUCAAUAAUUAG-3' | (SEQ ID NO: 2834) |
| | 3'-GUAAUAUACGUUCAAAAGUUAUUAAUC-5' | (SEQ ID NO: 2354) |
| MCL1-2232 Target: | 5'-CATTATATGCAAGTTTTCAATAATTAG-3' | (SEQ ID NO: 2450) |
| | 5'-AUAUGCAAGUUUUCAAUAAUUAGGUCU-3' | (SEQ ID NO: 2835) |
| | 3'-UAUACGUUCAAAAGUUAUUAAUCCAGA-5' | (SEQ ID NO: 2355) |
| MCL1-2236 Target: | 5'-ATATGCAAGTTTTCAATAATTAGGTCT-3' | (SEQ ID NO: 2451) |
| | 5'-AAGGUUACUGAUGACUUACAAAUAAUG-3' | (SEQ ID NO: 2836) |
| | 3'-UUCCAAUGACUACUGAAUGUUUAUUAC-5' | (SEQ ID NO: 2356) |
| MCL1-2275 Target: | 5'-AAGGTTACTGATGACTTACAAATAATG-3' | (SEQ ID NO: 2452) |
| | 5'-CUCUGAUUGGGCAAUACUCAUUUGAGU-3' | (SEQ ID NO: 2837) |
| | 3'-GAGACUAACCCGUUAUGAGUAAACUCA-5' | (SEQ ID NO: 2357) |
| MCL1-2304 Target: | 5'-CTCTGATTGGGCAATACTCATTTGAGT-3' | (SEQ ID NO: 2453) |

TABLE 9-continued

Selected Human Anti-MCL1 "Blunt/Blunt" DsiRNAs

| | | |
|---|---|---|
| MCL1-2314 Target: | 5'-GCAAUACUCAUUUGAGUUCCUUCCAUU-3'<br>3'-CGUUAUGAGUAAACUCAAGGAAGGUAA-5'<br>5'-GCAATACTCATTTGAGTTCCTTCCATT-3' | (SEQ ID NO: 2838)<br>(SEQ ID NO: 2358)<br>(SEQ ID NO: 2454) |
| MCL1-2352 Target: | 5'-AACUGGUGAAAUUUAAAGUGAAUUCAU-3'<br>3'-UUGACCACUUUAAAUUUCACUUAAGUA-5'<br>5'-AACTGGTGAAATTTAAAGTGAATTCAT-3' | (SEQ ID NO: 2839)<br>(SEQ ID NO: 2359)<br>(SEQ ID NO: 2455) |
| MCL1-2473 Target: | 5'-GACAUUUGAUCCCUUGUUUGCUUAAUA-3'<br>3'-CUGUAAACUAGGGAACAAACGAAUUAU-5'<br>5'-GACATTTGATCCCTTGTTTGCTTAATA-3' | (SEQ ID NO: 2840)<br>(SEQ ID NO: 2360)<br>(SEQ ID NO: 2456) |
| MCL1-2478 Target: | 5'-UUGAUCCCUUGUUUGCUUAAUAAAUUA-3'<br>3'-AACUAGGGAACAAACGAAUUAUUUAAU-5'<br>5'-TTGATCCCTTGTTTGCTTAATAAATTA-3' | (SEQ ID NO: 2841)<br>(SEQ ID NO: 2361)<br>(SEQ ID NO: 2457) |
| MCL1-2483 Target: | 5'-CCCUUGUUUGCUUAAUAAAUUAUAAAA-3'<br>3'-GGGAACAAACGAAUUAUUUAAUAUUUU-5'<br>5'-CCCTTGTTTGCTTAATAAATTATAAAA-3' | (SEQ ID NO: 2842)<br>(SEQ ID NO: 2362)<br>(SEQ ID NO: 2458) |
| MCL1-2486 Target: | 5'-UUGUUUGCUUAAUAAAUUAUAAAAUGA-3'<br>3'-AACAAACGAAUUAUUUAAUAUUUUACU-5'<br>5'-TTGTTTGCTTAATAAATTATAAAATGA-3' | (SEQ ID NO: 2843)<br>(SEQ ID NO: 2363)<br>(SEQ ID NO: 2459) |
| MCL1-2501 Target: | 5'-AUUAUAAAAUGAUGGCUUGGAAAAGCA-3'<br>3'-UAAUAUUUUACUACCGAACCUUUUCGU-5'<br>5'-ATTATAAAATGATGGCTTGGAAAAGCA-3' | (SEQ ID NO: 2844)<br>(SEQ ID NO: 2364)<br>(SEQ ID NO: 2460) |
| MCL1-2575 Target: | 5'-CAGGUCUAAGCCUAGUAUGUCAAUAAA-3'<br>3'-GUCCAGAUUCGGAUCAUACAGUUAUUU-5'<br>5'-CAGGTCTAAGCCTAGTATGTCAATAAA-3' | (SEQ ID NO: 2845)<br>(SEQ ID NO: 2365)<br>(SEQ ID NO: 2461) |
| MCL1-2584 Target: | 5'-GCCUAGUAUGUCAAUAAAGCAAAUACU-3'<br>3'-CGGAUCAUACAGUUAUUUCGUUUAUGA-5'<br>5'-GCCTAGTATGTCAATAAAGCAAATACT-3' | (SEQ ID NO: 2846)<br>(SEQ ID NO: 2366)<br>(SEQ ID NO: 2462) |
| MCL1-2591 Target: | 5'-AUGUCAAUAAAGCAAAUACUUACUGUU-3'<br>3'-UACAGUUAUUUCGUUUAUGAAUGACAA-5'<br>5'-ATGTCAATAAAGCAAATACTTACTGTT-3' | (SEQ ID NO: 2847)<br>(SEQ ID NO: 2367)<br>(SEQ ID NO: 2463) |
| MCL1-2593 Target: | 5'-GUCAAUAAAGCAAAUACUUACUGUUUU-3'<br>3'-CAGUUAUUUCGUUUAUGAAUGACAAAA-5'<br>5'-GTCAATAAAGCAAATACTTACTGTTTT-3' | (SEQ ID NO: 2848)<br>(SEQ ID NO: 2368)<br>(SEQ ID NO: 2464) |
| MCL1-2596 Target: | 5'-AAUAAAGCAAAUACUUACUGUUUUGUU-3'<br>3'-UUAUUUCGUUUAUGAAUGACAAAACAA-5'<br>5'-AATAAAGCAAATACTTACTGTTTTGTT-3' | (SEQ ID NO: 2849)<br>(SEQ ID NO: 2369)<br>(SEQ ID NO: 2465) |
| MCL1-2598 Target: | 5'-UAAAGCAAAUACUUACUGUUUUGUUUC-3'<br>3'-AUUUCGUUUAUGAAUGACAAAACAAAG-5'<br>5'-TAAAGCAAATACTTACTGTTTTGTTTC-3' | (SEQ ID NO: 2850)<br>(SEQ ID NO: 2370)<br>(SEQ ID NO: 2466) |
| MCL1-2602 Target: | 5'-GCAAAUACUUACUGUUUUGUUUCUAUU-3'<br>3'-CGUUUAUGAAUGACAAAACAAAGAUAA-5'<br>5'-GCAAATACTTACTGTTTTGTTTCTATT-3' | (SEQ ID NO: 2851)<br>(SEQ ID NO: 2371)<br>(SEQ ID NO: 2467) |
| MCL1-2605 Target: | 5'-AAUACUUACUGUUUUGUUUCUAUUAAU-3'<br>3'-UUAUGAAUGACAAAACAAAGAUAAUUA-5'<br>5'-AATACTTACTGTTTTGTTTCTATTAAT-3' | (SEQ ID NO: 2852)<br>(SEQ ID NO: 2372)<br>(SEQ ID NO: 2468) |
| MCL1-2607 Target: | 5'-UACUUACUGUUUUGUUUCUAUUAAUGA-3'<br>3'-AUGAAUGACAAAACAAAGAUAAUUACU-5'<br>5'-TACTTACTGTTTTGTTTCTATTAATGA-3' | (SEQ ID NO: 2853)<br>(SEQ ID NO: 2373)<br>(SEQ ID NO: 2469) |
| MCL1-2609 Target: | 5'-CUUACUGUUUUGUUUCUAUUAAUGAUU-3'<br>3'-GAAUGACAAAACAAAGAUAAUUACUAA-5'<br>5'-CTTACTGTTTTGTTTCTATTAATGATT-3' | (SEQ ID NO: 2854)<br>(SEQ ID NO: 2374)<br>(SEQ ID NO: 2470) |
| MCL1-2613 Target: | 5'-CUGUUUUGUUUCUAUUAAUGAUUCCCA-3'<br>3'-GACAAAACAAAGAUAAUUACUAAGGGU-5'<br>5'-CTGTTTTGTTTCTATTAATGATTCCCA-3' | (SEQ ID NO: 2855)<br>(SEQ ID NO: 2375)<br>(SEQ ID NO: 2471) |
| MCL1-2625 Target: | 5'-UAUUAAUGAUUCCCAAACCUUGUUGCA-3'<br>3'-AUAAUUACUAAGGGUUUGGAACAACGU-5'<br>5'-TATTAATGATTCCCAAACCTTGTTGCA-3' | (SEQ ID NO: 2856)<br>(SEQ ID NO: 2376)<br>(SEQ ID NO: 2472) |

TABLE 9-continued

Selected Human Anti-MCL1 "Blunt/Blunt" DsiRNAs

|  |  |  |
|---|---|---|
| MCL1-2636 Target: | 5'-CCCAAACCUUGUUGCAAGUUUUUGCAU-3'<br>3'-GGGUUUGGAACAACGUUCAAAAACGUA-5'<br>5'-CCCAAACCTTGTTGCAAGTTTTTGCAT-3' | (SEQ ID NO: 2857)<br>(SEQ ID NO: 2377)<br>(SEQ ID NO: 2473) |
| MCL1-2672 Target: | 5'-UGGAUUUCAGUCUUGAUGUUUGUUCUA-3'<br>3'-ACCUAAAGUCAGAACUACAAACAAGAU-5'<br>5'-TGGATTTCAGTCTTGATGTTTGTTCTA-3' | (SEQ ID NO: 2858)<br>(SEQ ID NO: 2378)<br>(SEQ ID NO: 2474) |
| MCL1-2679 Target: | 5'-CAGUCUUGAUGUUUGUUCUAUCAGACU-3'<br>3'-GUCAGAACUACAAACAAGAUAGUCUGA-5'<br>5'-CAGTCTTGATGTTTGTTCTATCAGACT-3' | (SEQ ID NO: 2859)<br>(SEQ ID NO: 2379)<br>(SEQ ID NO: 2475) |
| MCL1-2790 Target: | 5'-CCCUGCCAUCCCUGAACUCUUUCUAGC-3'<br>3'-GGGACGGUAGGGACUUGAGAAAGAUCG-5'<br>5'-CCCTGCCATCCCTGAACTCTTTCTAGC-3' | (SEQ ID NO: 2860)<br>(SEQ ID NO: 2380)<br>(SEQ ID NO: 2476) |
| MCL1-2799 Target: | 5'-CCCUGAACUCUUUCUAGCCCUUUUAGA-3'<br>3'-GGGACUUGAGAAAGAUCGGGAAAAUCU-5'<br>5'-CCCTGAACTCTTTCTAGCCCTTTTAGA-3' | (SEQ ID NO: 2861)<br>(SEQ ID NO: 2381)<br>(SEQ ID NO: 2477) |
| MCL1-2801 Target: | 5'-CUGAACUCUUUCUAGCCCUUUUAGAUU-3'<br>3'-GACUUGAGAAAGAUCGGGAAAAUCUAA-5'<br>5'-CTGAACTCTTTCTAGCCCTTTTAGATT-3' | (SEQ ID NO: 2862)<br>(SEQ ID NO: 2382)<br>(SEQ ID NO: 2478) |
| MCL1-2911 Target: | 5'-UUGAUCCUGUUAGCAGGUGGUAAUACC-3'<br>3'-AACUAGGACAAUCGUCCACCAUUAUGG-5'<br>5'-TTGATCCTGTTAGCAGGTGGTAATACC-3' | (SEQ ID NO: 2863)<br>(SEQ ID NO: 2383)<br>(SEQ ID NO: 2479) |
| MCL1-2992 Target: | 5'-UGGACUGGUAUCUUUUCAACUAUUGUU-3'<br>3'-ACCUGACCAUAGAAAAGUUGAUAACAA-5'<br>5'-TGGACTGGTATCTTTTCAACTATTGTT-3' | (SEQ ID NO: 2864)<br>(SEQ ID NO: 2384)<br>(SEQ ID NO: 2480) |
| MCL1-3072 Target: | 5'-GAAAGAACAUUUUAUGAGGCUUUCUCU-3'<br>3'-CUUUCUUGUAAAAUACUCCGAAAGAGA-5'<br>5'-GAAAGAACATTTTATGAGGCTTTCTCT-3' | (SEQ ID NO: 2865)<br>(SEQ ID NO: 2385)<br>(SEQ ID NO: 2481) |
| MCL1-3074 Target: | 5'-AAGAACAUUUUAUGAGGCUUUCUCUAA-3'<br>3'-UUCUUGUAAAAUACUCCGAAAGAGAUU-5'<br>5'-AAGAACATTTTATGAGGCTTTCTCTAA-3' | (SEQ ID NO: 2866)<br>(SEQ ID NO: 2386)<br>(SEQ ID NO: 2482) |
| MCL1-3252 Target: | 5'-UUAGUCUGUGGACUCCAUUUAAAAAUA-3'<br>3'-AAUCAGACACCUGAGGUAAAUUUUUAU-5'<br>5'-TTAGTCTGTGGACTCCATTTAAAAATA-3' | (SEQ ID NO: 2867)<br>(SEQ ID NO: 2387)<br>(SEQ ID NO: 2483) |
| MCL1-3563 Target: | 5'-UUCAUUAGGUAUGACUGUGGAAAUACA-3'<br>3'-AAGUAAUCCAUACUGACACCUUUAUGU-5'<br>5'-TTCATTAGGTATGACTGTGGAAATACA-3' | (SEQ ID NO: 2868)<br>(SEQ ID NO: 2388)<br>(SEQ ID NO: 2484) |
| MCL1-3588 Target: | 5'-CAGACAAGGAUCUUAGUUGAUAUUUUG-3'<br>3'-GUCUGUUCCUAGAAUCAACUAUAAAAC-5'<br>5'-CAGACAAGGATCTTAGTTGATATTTTG-3' | (SEQ ID NO: 2869)<br>(SEQ ID NO: 2389)<br>(SEQ ID NO: 2485) |
| MCL1-3789 Target: | 5'-GUGACUACUUUUUGACUUCUGUUUGUC-3'<br>3'-CACUGAUGAAAAACUGAAGACAAACAG-5'<br>5'-GTGACTACTTTTTGACTTCTGTTTGTC-3' | (SEQ ID NO: 2870)<br>(SEQ ID NO: 2390)<br>(SEQ ID NO: 2486) |
| MCL1-3989 Target: | 5'-UUCUGUUUUUCCUGAGAAAAAAAAUA-3'<br>3'-AAGACAAAAAGGACUCUUUUUUUUUAU-5'<br>5'-TTCTGTTTTTCCTGAGAAAAAAAATA-3' | (SEQ ID NO: 2871)<br>(SEQ ID NO: 2391)<br>(SEQ ID NO: 2487) |
| MCL1-3991 Target: | 5'-CUGUUUUUCCUGAGAAAAAAAAUAAA-3'<br>3'-GACAAAAAGGACUCUUUUUUUUUAUUU-5'<br>5'-CTGTTTTTCCTGAGAAAAAAAATAAA-3' | (SEQ ID NO: 2872)<br>(SEQ ID NO: 2392)<br>(SEQ ID NO: 2488) |
| MCL1-3997 Target: | 5'-UUCCUGAGAAAAAAAAUAAAUCUUUU-3'<br>3'-AAGGACUCUUUUUUUUAUUUAGAAAA-5'<br>5'-TTCCTGAGAAAAAAAATAAATCTTTT-3' | (SEQ ID NO: 2873)<br>(SEQ ID NO: 2393)<br>(SEQ ID NO: 2489) |
| MCL1-4000 Target: | 5'-CUGAGAAAAAAAAUAAAUCUUUUAUU-3'<br>3'-GACUCUUUUUUUUAUUUAGAAAAUAA-5'<br>5'-CTGAGAAAAAAAATAAATCTTTTATT-3' | (SEQ ID NO: 2874)<br>(SEQ ID NO: 2394)<br>(SEQ ID NO: 2490) |
| MCL1-4002 Target: | 5'-GAGAAAAAAAAUAAAUCUUUUAUUCA-3'<br>3'-CUCUUUUUUUUAUUUAGAAAAUAAGU-5'<br>5'-GAGAAAAAAAATAAATCTTTTATTCA-3' | (SEQ ID NO: 2875)<br>(SEQ ID NO: 2395)<br>(SEQ ID NO: 2491) |

TABLE 9-continued

Selected Human Anti-MCL1 "Blunt/Blunt" DsiRNAs

|  |  |  |
|---|---|---|
|  | 5'-AAAAAAUAAAUCUUUUAUUCAAAAAAA-3' | (SEQ ID NO: 2876) |
|  | 3'-UUUUUUAUUUAGAAAAUAAGUUUUUUU-5' | (SEQ ID NO: 2396) |
| MCL1-4008 Target: | 5'-AAAAAATAAATCTTTTATTCAAAAAAA-3' | (SEQ ID NO: 2492) |

TABLE 10

Selected Mouse Anti-MCL1 "Blunt/Blunt" DsiRNAs

|  |  |  |
|---|---|---|
|  | 5'-AGGGAACGGCCUUCCUCACUCCUGACU-3' | (SEQ ID NO: 2091) |
|  | 3'-UCCCUUGCCGGAAGGAGUGAGGACUGA-5' | (SEQ ID NO: 516) |
| MCL1-m69 Target: | 5'-AGGGAACGGCCTTCCTCACTCCTGACT-3' | (SEQ ID NO: 831) |
|  | 5'-CUGCGGAGAAACGCGGUCAUCGGCUUG-3' | (SEQ ID NO: 2092) |
|  | 3'-GACGCCUCUUUGCGCCAGUAGCCGAAC-5' | (SEQ ID NO: 517) |
| MCL1-m172 Target: | 5'-CTGCGGAGAAACGCGGTCATCGGCTTG-3' | (SEQ ID NO: 832) |
|  | 5'-CCGGAGGAGGAACUGGACGGCUGCGAG-3' | (SEQ ID NO: 2093) |
|  | 3'-GGCCUCCUCCUUGACCUGCCGACGCUC-5' | (SEQ ID NO: 518) |
| MCL1-m469 Target: | 5'-CCGGAGGAGGAACTGGACGGCTGCGAG-3' | (SEQ ID NO: 833) |
|  | 5'-CGAGGAGGAAGAGGACGACCUAUACCG-3' | (SEQ ID NO: 2094) |
|  | 3'-GCUCCUCCUUCUCCUGCUGGAUAUGGC-5' | (SEQ ID NO: 519) |
| MCL1-m606 Target: | 5'-CGAGGAGGAAGAGGACGACCTATACCG-3' | (SEQ ID NO: 834) |
|  | 5'-GAGGAGGAAGAGGACGACCUAUACCGC-3' | (SEQ ID NO: 2095) |
|  | 3'-CUCCUCCUUCUCCUGCUGGAUAUGGCG-5' | (SEQ ID NO: 520) |
| MCL1-m607 Target: | 5'-GAGGAGGAAGAGGACGACCTATACCGC-3' | (SEQ ID NO: 835) |
|  | 5'-AGGAGGAAGAGGACGACCUAUACCGCC-3' | (SEQ ID NO: 2096) |
|  | 3'-UCCUCCUUCUCCUGCUGGAUAUGGCGG-5' | (SEQ ID NO: 521) |
| MCL1-m608 Target: | 5'-AGGAGGAAGAGGACGACCTATACCGCC-3' | (SEQ ID NO: 836) |
|  | 5'-GAGGAAGAGGACGACCUAUACCGCCAG-3' | (SEQ ID NO: 2097) |
|  | 3'-CUCCUUCUCCUGCUGGAUAUGGCGGUC-5' | (SEQ ID NO: 522) |
| MCL1-m610 Target: | 5'-GAGGAAGAGGACGACCTATACCGCCAG-3' | (SEQ ID NO: 837) |
|  | 5'-CAGGAUUGUGACUCUUAUUUCUUUCGG-3' | (SEQ ID NO: 2098) |
|  | 3'-GUCCUAACACUGAGAAUAAAGAAAGCC-5' | (SEQ ID NO: 523) |
| MCL1-m891 Target: | 5'-CAGGATTGTGACTCTTATTTCTTTCGG-3' | (SEQ ID NO: 838) |
|  | 5'-UGUGGCCAAACACUUAAAGAGCGUAAA-3' | (SEQ ID NO: 2099) |
|  | 3'-ACACCGGUUUGUGAAUUUCUCGCAUUU-5' | (SEQ ID NO: 524) |
| MCL1-m924 Target: | 5'-TGTGGCCAAACACTTAAAGAGCGTAAA-3' | (SEQ ID NO: 839) |
|  | 5'-GUGGCCAAACACUUAAAGAGCGUAAAC-3' | (SEQ ID NO: 2100) |
|  | 3'-CACCGGUUUGUGAAUUUCUCGCAUUUG-5' | (SEQ ID NO: 525) |
| MCL1-m925 Target: | 5'-GTGGCCAAACACTTAAAGAGCGTAAAC-3' | (SEQ ID NO: 840) |
|  | 5'-UGGCCAAACACUUAAAGAGCGUAAACC-3' | (SEQ ID NO: 2101) |
|  | 3'-ACCGGUUUGUGAAUUUCUCGCAUUUGG-5' | (SEQ ID NO: 526) |
| MCL1-m926 Target: | 5'-TGGCCAAACACTTAAAGAGCGTAAACC-3' | (SEQ ID NO: 841) |
|  | 5'-AAAGAGCGUAAACCAAGAAAGCUUCAU-3' | (SEQ ID NO: 2102) |
|  | 3'-UUUCUCGCAUUUGGUUCUUUCGAAGUA-5' | (SEQ ID NO: 527) |
| MCL1-m939 Target: | 5'-AAAGAGCGTAAACCAAGAAAGCTTCAT-3' | (SEQ ID NO: 842) |
|  | 5'-CGAACCAUUAGCAGAAACUAUCACAGA-3' | (SEQ ID NO: 2103) |
|  | 3'-GCUUGGUAAUCGUCUUUGAUAGUGUCU-5' | (SEQ ID NO: 528) |
| MCL1-m966 Target: | 5'-CGAACCATTAGCAGAAACTATCACAGA-3' | (SEQ ID NO: 843) |
|  | 5'-UUAGCAGAAACUAUCACAGAUGUUCUU-3' | (SEQ ID NO: 2104) |
|  | 3'-AAUCGUCUUUGAUAGUGUCUACAAGAA-5' | (SEQ ID NO: 529) |
| MCL1-m973 Target: | 5'-TTAGCAGAAACTATCACAGATGTTCTT-3' | (SEQ ID NO: 844) |
|  | 5'-ACGGGACUGGCUUGUCAAACAAAGAGG-3' | (SEQ ID NO: 2105) |
|  | 3'-UGCCCUGACCGAACAGUUUGUUUCUCC-5' | (SEQ ID NO: 530) |
| MCL1-m1011 Target: | 5'-ACGGGACTGGCTTGTCAAACAAAGAGG-3' | (SEQ ID NO: 845) |
|  | 5'-CGGGACUGGCUUGUCAAACAAAGAGGC-3' | (SEQ ID NO: 2106) |
|  | 3'-GCCCUGACCGAACAGUUUGUUUCUCCG-5' | (SEQ ID NO: 531) |
| MCL1-m1012 Target: | 5'-CGGGACTGGCTTGTCAAACAAAGAGGC-3' | (SEQ ID NO: 846) |
|  | 5'-UUGUGGAGUUCUUCCACGUACAGGACC-3' | (SEQ ID NO: 2107) |
|  | 3'-AACACCUCAAGAAGGUGCAUGUCCUGG-5' | (SEQ ID NO: 532) |
| MCL1-m1049 Target: | 5'-TTGTGGAGTTCTTCCACGTACAGGACC-3' | (SEQ ID NO: 847) |

TABLE 10-continued

Selected Mouse Anti-MCL1 "Blunt/Blunt" DsiRNAs

| | | |
|---|---|---|
| MCL1-m1053 Target: | 5'-GGAGUUCUUCCACGUACAGGACCUAGA-3'<br>3'-CCUCAAGAAGGUGCAUGUCCUGGAUCU-5'<br>5'-GGAGTTCTTCCACGTACAGGACCTAGA-3' | (SEQ ID NO: 2108)<br>(SEQ ID NO: 533)<br>(SEQ ID NO: 848) |
| MCL1-m1060 Target: | 5'-UUCCACGUACAGGACCUAGAAGGCGGC-3'<br>3'-AAGGUGCAUGUCCUGGAUCUUCCGCCG-5'<br>5'-TTCCACGTACAGGACCTAGAAGGCGGC-3' | (SEQ ID NO: 2109)<br>(SEQ ID NO: 534)<br>(SEQ ID NO: 849) |
| MCL1-m1133 Target: | 5'-CUGGUCUGGCAUAUCUAAUAAGAUAGC-3'<br>3'-GACCAGACCGUAUAGAUUAUUCUAUCG-5'<br>5'-CTGGTCTGGCATATCTAATAAGATAGC-3' | (SEQ ID NO: 2110)<br>(SEQ ID NO: 535)<br>(SEQ ID NO: 850) |
| MCL1-m1193 Target: | 5'-AGCCACCAAACUACAUGCAUCUGUGAA-3'<br>3'-UCGGUGGUUUGAUGUACGUAGACACUU-5'<br>5'-AGCCACCAAACTACATGCATCTGTGAA-3' | (SEQ ID NO: 2111)<br>(SEQ ID NO: 536)<br>(SEQ ID NO: 851) |
| MCL1-m1222 Target: | 5'-CAUGUGUAUUUAUGAAGGUGGACUUGA-3'<br>3'-GUACACAUAAAUACUUCCACCUGAACU-5'<br>5'-CATGTGTATTTATGAAGGTGGACTTGA-3' | (SEQ ID NO: 2112)<br>(SEQ ID NO: 537)<br>(SEQ ID NO: 852) |
| MCL1-m1224 Target: | 5'-UGUGUAUUUAUGAAGGUGGACUUGAAG-3'<br>3'-ACACAUAAAUACUUCCACCUGAACUUC-5'<br>5'-TGTGTATTTATGAAGGTGGACTTGAAG-3' | (SEQ ID NO: 2113)<br>(SEQ ID NO: 538)<br>(SEQ ID NO: 853) |
| MCL1-m1227 Target: | 5'-GUAUUUAUGAAGGUGGACUUGAAGCUG-3'<br>3'-CAUAAAUACUUCCACCUGAACUUCGAC-5'<br>5'-GTATTTATGAAGGTGGACTTGAAGCTG-3' | (SEQ ID NO: 2114)<br>(SEQ ID NO: 539)<br>(SEQ ID NO: 854) |
| MCL1-m1269 Target: | 5'-GUCCAGUUCUACUGUAGCAACAUAGCA-3'<br>3'-CAGGUCAAGAUGACAUCGUUGUAUCGU-5'<br>5'-GTCCAGTTCTACTGTAGCAACATAGCA-3' | (SEQ ID NO: 2115)<br>(SEQ ID NO: 540)<br>(SEQ ID NO: 855) |
| MCL1-m1355 Target: | 5'-CCCUGGAAGAGUCACUGUCUGAAUGAA-3'<br>3'-GGGACCUUCUCAGUGACAGACUUACUU-5'<br>5'-CCCTGGAAGAGTCACTGTCTGAATGAA-3' | (SEQ ID NO: 2116)<br>(SEQ ID NO: 541)<br>(SEQ ID NO: 856) |
| MCL1-m1356 Target: | 5'-CCUGGAAGAGUCACUGUCUGAAUGAAG-3'<br>3'-GGACCUUCUCAGUGACAGACUUACUUC-5'<br>5'-CCTGGAAGAGTCACTGTCTGAATGAAG-3' | (SEQ ID NO: 2117)<br>(SEQ ID NO: 542)<br>(SEQ ID NO: 857) |
| MCL1-m1357 Target: | 5'-CUGGAAGAGUCACUGUCUGAAUGAAGC-3'<br>3'-GACCUUCUCAGUGACAGACUUACUUCG-5'<br>5'-CTGGAAGAGTCACTGTCTGAATGAAGC-3' | (SEQ ID NO: 2118)<br>(SEQ ID NO: 543)<br>(SEQ ID NO: 858) |
| MCL1-m1367 Target: | 5'-CACUGUCUGAAUGAAGCAAAGUUCCCU-3'<br>3'-GUGACAGACUUACUUCGUUUCAAGGGA-5'<br>5'-CACTGTCTGAATGAAGCAAAGTTCCCT-3' | (SEQ ID NO: 2119)<br>(SEQ ID NO: 544)<br>(SEQ ID NO: 859) |
| MCL1-m1388 Target: | 5'-UUCCCUCUCAGCAAACACUGAGAGGCC-3'<br>3'-AAGGGAGAGUCGUUUGUGACUCUCCGG-5'<br>5'-TTCCCTCTCAGCAAACACTGAGAGGCC-3' | (SEQ ID NO: 2120)<br>(SEQ ID NO: 545)<br>(SEQ ID NO: 860) |
| MCL1-m1389 Target: | 5'-UCCCUCUCAGCAAACACUGAGAGGCCA-3'<br>3'-AGGGAGAGUCGUUUGUGACUCUCCGGU-5'<br>5'-TCCCTCTCAGCAAACACTGAGAGGCCA-3' | (SEQ ID NO: 2121)<br>(SEQ ID NO: 546)<br>(SEQ ID NO: 861) |
| MCL1-m1395 Target: | 5'-UCAGCAAACACUGAGAGGCCAUGGAGA-3'<br>3'-AGUCGUUUGUGACUCUCCGGUACCUCU-5'<br>5'-TCAGCAAACACTGAGAGGCCATGGAGA-3' | (SEQ ID NO: 2122)<br>(SEQ ID NO: 547)<br>(SEQ ID NO: 862) |
| MCL1-m1401 Target: | 5'-AACACUGAGAGGCCAUGGAGAAGGACU-3'<br>3'-UUGUGACUCUCCGGUACCUCUUCCUGA-5'<br>5'-AACACTGAGAGGCCATGGAGAAGGACT-3' | (SEQ ID NO: 2123)<br>(SEQ ID NO: 548)<br>(SEQ ID NO: 863) |
| MCL1-m1409 Target: | 5'-GAGGCCAUGGAGAAGGACUUCUAGAAU-3'<br>3'-CUCCGGUACCUCUUCCUGAAGAUCUUA-5'<br>5'-GAGGCCATGGAGAAGGACTTCTAGAAT-3' | (SEQ ID NO: 2124)<br>(SEQ ID NO: 549)<br>(SEQ ID NO: 864) |
| MCL1-m1410 Target: | 5'-AGGCCAUGGAGAAGGACUUCUAGAAUG-3'<br>3'-UCCGGUACCUCUUCCUGAAGAUCUUAC-5'<br>5'-AGGCCATGGAGAAGGACTTCTAGAATG-3' | (SEQ ID NO: 2125)<br>(SEQ ID NO: 550)<br>(SEQ ID NO: 865) |
| MCL1-m1416 Target: | 5'-UGGAGAAGGACUUCUAGAAUGAAUGAA-3'<br>3'-ACCUCUUCCUGAAGAUCUUACUUACUU-5'<br>5'-TGGAGAAGGACTTCTAGAATGAATGAA-3' | (SEQ ID NO: 2126)<br>(SEQ ID NO: 551)<br>(SEQ ID NO: 866) |

TABLE 10-continued

Selected Mouse Anti-MCL1 "Blunt/Blunt" DsiRNAs

|  |  |  |
|---|---|---|
| MCL1-m1420 Target: | 5'-GAAGGACUUCUAGAAUGAAUGAAAGGG-3'<br>3'-CUUCCUGAAGAUCUUACUUACUUUCCC-5'<br>5'-GAAGGACTTCTAGAATGAATGAAAGGG-3' | (SEQ ID NO: 2127)<br>(SEQ ID NO: 552)<br>(SEQ ID NO: 867) |
| MCL1-m1447 Target: | 5'-GUGGAUGGAAAGGUUUGAUUUCCUAUC-3'<br>3'-CACCUACCUUUCCAAACUAAAGGAUAG-5'<br>5'-GTGGATGGAAAGGTTTGATTTCCTATC-3' | (SEQ ID NO: 2128)<br>(SEQ ID NO: 553)<br>(SEQ ID NO: 868) |
| MCL1-m1491 Target: | 5'-CCAGUCAUCAGGCUAGUCACAAAGCUC-3'<br>3'-GGUCAGUAGUCCGAUCAGUGUUUCGAG-5'<br>5'-CCAGTCATCAGGCTAGTCACAAAGCTC-3' | (SEQ ID NO: 2129)<br>(SEQ ID NO: 554)<br>(SEQ ID NO: 869) |
| MCL1-m1492 Target: | 5'-CAGUCAUCAGGCUAGUCACAAAGCUCA-3'<br>3'-GUCAGUAGUCCGAUCAGUGUUUCGAGU-5'<br>5'-CAGTCATCAGGCTAGTCACAAAGCTCA-3' | (SEQ ID NO: 2130)<br>(SEQ ID NO: 555)<br>(SEQ ID NO: 870) |
| MCL1-m1500 Target: | 5'-AGGCUAGUCACAAAGCUCAAUAAAUAU-3'<br>3'-UCCGAUCAGUGUUUCGAGUUAUUUAUA-5'<br>5'-AGGCTAGTCACAAAGCTCAATAAATAT-3' | (SEQ ID NO: 2131)<br>(SEQ ID NO: 556)<br>(SEQ ID NO: 871) |
| MCL1-m1556 Target: | 5'-AAGCCCUAAUUAACAACGUUGGUGACU-3'<br>3'-UUCGGGAUUAAUUGUUGCAACCACUGA-5'<br>5'-AAGCCCTAATTAACAACGTTGGTGACT-3' | (SEQ ID NO: 2132)<br>(SEQ ID NO: 557)<br>(SEQ ID NO: 872) |
| MCL1-m1601 Target: | 5'-AACCUACAAGUCACCAAACGAUGACUA-3'<br>3'-UUGGAUGUUCAGUGGUUUGCUACUGAU-5'<br>5'-AACCTACAAGTCACCAAACGATGACTA-3' | (SEQ ID NO: 2133)<br>(SEQ ID NO: 558)<br>(SEQ ID NO: 873) |
| MCL1-m1602 Target: | 5'-ACCUACAAGUCACCAAACGAUGACUAG-3'<br>3'-UGGAUGUUCAGUGGUUUGCUACUGAUC-5'<br>5'-ACCTACAAGTCACCAAACGATGACTAG-3' | (SEQ ID NO: 2134)<br>(SEQ ID NO: 559)<br>(SEQ ID NO: 874) |
| MCL1-m1609 Target: | 5'-AGUCACCAAACGAUGACUAGAAGCUGC-3'<br>3'-UCAGUGGUUUGCUACUGAUCUUCGACG-5'<br>5'-AGTCACCAAACGATGACTAGAAGCTGC-3' | (SEQ ID NO: 2135)<br>(SEQ ID NO: 560)<br>(SEQ ID NO: 875) |
| MCL1-m1610 Target: | 5'-GUCACCAAACGAUGACUAGAAGCUGCA-3'<br>3'-CAGUGGUUUGCUACUGAUCUUCGACGU-5'<br>5'-GTCACCAAACGATGACTAGAAGCTGCA-3' | (SEQ ID NO: 2136)<br>(SEQ ID NO: 561)<br>(SEQ ID NO: 876) |
| MCL1-m1611 Target: | 5'-UCACCAAACGAUGACUAGAAGCUGCAG-3'<br>3'-AGUGGUUUGCUACUGAUCUUCGACGUC-5'<br>5'-TCACCAAACGATGACTAGAAGCTGCAG-3' | (SEQ ID NO: 2137)<br>(SEQ ID NO: 562)<br>(SEQ ID NO: 877) |
| MCL1-m1612 Target: | 5'-CACCAAACGAUGACUAGAAGCUGCAGU-3'<br>3'-GUGGUUUGCUACUGAUCUUCGACGUCA-5'<br>5'-CACCAAACGATGACTAGAAGCTGCAGT-3' | (SEQ ID NO: 2138)<br>(SEQ ID NO: 563)<br>(SEQ ID NO: 878) |
| MCL1-m1645 Target: | 5'-CAGGAAUGUGAAGGGAGGCCUCUGAGC-3'<br>3'-GUCCUUACACUUCCCUCCGGAGACUCG-5'<br>5'-CAGGAATGTGAAGGGAGGCCTCTGAGC-3' | (SEQ ID NO: 2139)<br>(SEQ ID NO: 564)<br>(SEQ ID NO: 879) |
| MCL1-m1681 Target: | 5'-UGUGCUUGACAAAGUCCCAAGUGCUCA-3'<br>3'-ACACGAACUGUUUCAGGGUUCACGAGU-5'<br>5'-TGTGCTTGACAAAGTCCCAAGTGCTCA-3' | (SEQ ID NO: 2140)<br>(SEQ ID NO: 565)<br>(SEQ ID NO: 880) |
| MCL1-m1682 Target: | 5'-GUGCUUGACAAAGUCCCAAGUGCUCAG-3'<br>3'-CACGAACUGUUUCAGGGUUCACGAGUC-5'<br>5'-GTGCTTGACAAAGTCCCAAGTGCTCAG-3' | (SEQ ID NO: 2141)<br>(SEQ ID NO: 566)<br>(SEQ ID NO: 881) |
| MCL1-m1686 Target: | 5'-UUGACAAAGUCCCAAGUGCUCAGGACU-3'<br>3'-AACUGUUUCAGGGUUCACGAGUCCUGA-5'<br>5'-TTGACAAAGTCCCAAGTGCTCAGGACT-3' | (SEQ ID NO: 2142)<br>(SEQ ID NO: 567)<br>(SEQ ID NO: 882) |
| MCL1-m1716 Target: | 5'-AGCCCUGUCUACUUUGGCUUGGUUUGG-3'<br>3'-UCGGGACAGAUGAAACCGAACCAAACC-5'<br>5'-AGCCCTGTCTACTTTGGCTTGGTTTGG-3' | (SEQ ID NO: 2143)<br>(SEQ ID NO: 568)<br>(SEQ ID NO: 883) |
| MCL1-m1747 Target: | 5'-UUCUUAAGUUUAUUAGCCUAGUGAUGG-3'<br>3'-AAGAAUUCAAAUAAUCGGAUCACUACC-5'<br>5'-TTCTTAAGTTTATTAGCCTAGTGATGG-3' | (SEQ ID NO: 2144)<br>(SEQ ID NO: 569)<br>(SEQ ID NO: 884) |
| MCL1-m1778 Target: | 5'-AAAGUACUUGACUUAAGGUUCACUAAU-3'<br>3'-UUUCAUGAACUGAAUUCCAAGUGAUUA-5'<br>5'-AAAGTACTTGACTTAAGGTTCACTAAT-3' | (SEQ ID NO: 2145)<br>(SEQ ID NO: 570)<br>(SEQ ID NO: 885) |

TABLE 10-continued

Selected Mouse Anti-MCL1 "Blunt/Blunt" DsiRNAs

|  |  |  |
| --- | --- | --- |
| MCL1-m1902 Target: | 5'-GAACAUAAGAGGGAAGUCUUGGAUUUA-3'<br>3'-CUUGUAUUCUCCCUUCAGAACCUAAAU-5'<br>5'-GAACATAAGAGGGAAGTCTTGGATTTA-3' | (SEQ ID NO: 2146)<br>(SEQ ID NO: 571)<br>(SEQ ID NO: 886) |
| MCL1-m1957 Target: | 5'-CAGCUUCUCUAGUUAGAAAUGUAUUUC-3'<br>3'-GUCGAAGAGAUCAAUCUUUACAUAAAG-5'<br>5'-CAGCTTCTCTAGTTAGAAATGTATTTC-3' | (SEQ ID NO: 2147)<br>(SEQ ID NO: 572)<br>(SEQ ID NO: 887) |
| MCL1-m2003 Target: | 5'-UGUCAUCCGUUCUAGUGUAUAUGCAGA-3'<br>3'-ACAGUAGGCAAGAUCACAUAUACGUCU-5'<br>5'-TGTCATCCGTTCTAGTGTATATGCAGA-3' | (SEQ ID NO: 2148)<br>(SEQ ID NO: 573)<br>(SEQ ID NO: 888) |
| MCL1-m2038 Target: | 5'-UGUGUGUGGACUGGUUAUAGAUUUAUA-3'<br>3'-ACACACACCUGACCAAUAUCUAAAUAU-5'<br>5'-TGTGTGTGGACTGGTTATAGATTTATA-3' | (SEQ ID NO: 2149)<br>(SEQ ID NO: 574)<br>(SEQ ID NO: 889) |
| MCL1-m2063 Target: | 5'-UAACUAUGCAGGGUUAAUUAUCCAAUC-3'<br>3'-AUUGAUACGUCCCAAUUAAUAGGUUAG-5'<br>5'-TAACTATGCAGGGTTAATTATCCAATC-3' | (SEQ ID NO: 2150)<br>(SEQ ID NO: 575)<br>(SEQ ID NO: 890) |
| MCL1-m2110 Target: | 5'-AUCACAGGUAGAUAGAUGUAAGACAUU-3'<br>3'-UAGUGUCCAUCUAUCUACAUUCUGUAA-5'<br>5'-ATCACAGGTAGATAGATGTAAGACATT-3' | (SEQ ID NO: 2151)<br>(SEQ ID NO: 576)<br>(SEQ ID NO: 891) |
| MCL1-m2115 Target: | 5'-AGGUAGAUAGAUGUAAGACAUUUGAUC-3'<br>3'-UCCAUCUAUCUACAUUCUGUAAACUAG-5'<br>5'-AGGTAGATAGATGTAAGACATTTGATC-3' | (SEQ ID NO: 2152)<br>(SEQ ID NO: 577)<br>(SEQ ID NO: 892) |
| MCL1-m2162 Target: | 5'-GUAAAUGGUAAAGCAGGCUAGAGUCUU-3'<br>3'-CAUUUACCAUUUCGUCCGAUCUCAGAA-5'<br>5'-GTAAATGGTAAAGCAGGCTAGAGTCTT-3' | (SEQ ID NO: 2153)<br>(SEQ ID NO: 578)<br>(SEQ ID NO: 893) |
| MCL1-m2193 Target: | 5'-AUGGUGCUAUUCACUGGGUUUACUUGU-3'<br>3'-UACCACGAUAAGUGACCCAAAUGAACA-5'<br>5'-ATGGTGCTATTCACTGGGTTTACTTGT-3' | (SEQ ID NO: 2154)<br>(SEQ ID NO: 579)<br>(SEQ ID NO: 894) |
| MCL1-m2262 Target: | 5'-UUUCUUGUCUACUAAGGAUUGCCAAGC-3'<br>3'-AAAGAACAGAUGAUUCCUAACGGUUCG-5'<br>5'-TTTCTTGTCTACTAAGGATTGCCAAGC-3' | (SEQ ID NO: 2155)<br>(SEQ ID NO: 580)<br>(SEQ ID NO: 895) |
| MCL1-m2309 Target: | 5'-UGGUCUCUAGGUGUAGCCUUUACUUCC-3'<br>3'-ACCAGAGAUCCACAUCGGAAAUGAAGG-5'<br>5'-TGGTCTCTAGGTGTAGCCTTTACTTCC-3' | (SEQ ID NO: 2156)<br>(SEQ ID NO: 581)<br>(SEQ ID NO: 896) |
| MCL1-m2366 Target: | 5'-CCCUAUAGAGUCGUCUACACUUCCUCC-3'<br>3'-GGGAUAUCUCAGCAGAUGUGAAGGAGG-5'<br>5'-CCCTATAGAGTCGTCTACACTTCCTCC-3' | (SEQ ID NO: 2157)<br>(SEQ ID NO: 582)<br>(SEQ ID NO: 897) |
| MCL1-m2375 Target: | 5'-GUCGUCUACACUUCCUCCCUGUGCUCU-3'<br>3'-CAGCAGAUGUGAAGGAGGGACACGAGA-5'<br>5'-GTCGTCTACACTTCCTCCCTGTGCTCT-3' | (SEQ ID NO: 2158)<br>(SEQ ID NO: 583)<br>(SEQ ID NO: 898) |
| MCL1-m2415 Target: | 5'-UAGUUAUCUGCAUUAGAACUCUCACCC-3'<br>3'-AUCAAUAGACGUAAUCUUGAGAGUGGG-5'<br>5'-TAGTTATCTGCATTAGAACTCTCACCC-3' | (SEQ ID NO: 2159)<br>(SEQ ID NO: 584)<br>(SEQ ID NO: 899) |
| MCL1-m2482 Target: | 5'-AUCCUAAUCAGAGUCAGCACAGCUUUC-3'<br>3'-UAGGAUUAGUCUCAGUCGUGUCGAAAG-5'<br>5'-ATCCTAATCAGAGTCAGCACAGCTTTC-3' | (SEQ ID NO: 2160)<br>(SEQ ID NO: 585)<br>(SEQ ID NO: 900) |
| MCL1-m2500 Target: | 5'-ACAGCUUUCCUGUCAGAGGAUAGGAAC-3'<br>3'-UGUCGAAAGGACAGUCUCCUAUCCUUG-5'<br>5'-ACAGCTTTCCTGTCAGAGGATAGGAAC-3' | (SEQ ID NO: 2161)<br>(SEQ ID NO: 586)<br>(SEQ ID NO: 901) |
| MCL1-m2506 Target: | 5'-UUCCUGUCAGAGGAUAGGAACACUUGC-3'<br>3'-AAGGACAGUCUCCUAUCCUUGUGAACG-5'<br>5'-TTCCTGTCAGAGGATAGGAACACTTGC-3' | (SEQ ID NO: 2162)<br>(SEQ ID NO: 587)<br>(SEQ ID NO: 902) |
| MCL1-m2509 Target: | 5'-CUGUCAGAGGAUAGGAACACUUGCUCU-3'<br>3'-GACAGUCUCCUAUCCUUGUGAACGAGA-5'<br>5'-CTGTCAGAGGATAGGAACACTTGCTCT-3' | (SEQ ID NO: 2163)<br>(SEQ ID NO: 588)<br>(SEQ ID NO: 903) |
| MCL1-m2510 Target: | 5'-UGUCAGAGGAUAGGAACACUUGCUCUU-3'<br>3'-ACAGUCUCCUAUCCUUGUGAACGAGAA-5'<br>5'-TGTCAGAGGATAGGAACACTTGCTCTT-3' | (SEQ ID NO: 2164)<br>(SEQ ID NO: 589)<br>(SEQ ID NO: 904) |

TABLE 10-continued

Selected Mouse Anti-MCL1 "Blunt/Blunt" DsiRNAs

```
                    5'-GACCGACAGUGACCAGGGAUUGGCAUU-3'  (SEQ ID NO: 2165)
                    3'-CUGGCUGUCACUGGUCCCUAACCGUAA-5'  (SEQ ID NO: 590)
MCL1-m2547 Target:  5'-GACCGACAGTGACCAGGGATTGGCATT-3'  (SEQ ID NO: 905)

5'-CAUGCUUUCCAUUGUUACUUUGUCUAU-3'  (SEQ ID NO: 2166)
                    3'-GUACGAAAGGUAACAAUGAAACAGAUA-5'  (SEQ ID NO: 591)
MCL1-m2584 Target:  5'-CATGCTTTCCATTGTTACTTTGTCTAT-3'  (SEQ ID NO: 906)

5'-AAGGUUGGAAAUUAUACGUUUAUACUU-3'  (SEQ ID NO: 2167)
                    3'-UUCCAACCUUUAAUAUGCAAAUAUGAA-5'  (SEQ ID NO: 592)
MCL1-m2651 Target:  5'-AAGGTTGGAAATTATACGTTTATACTT-3'  (SEQ ID NO: 907)

5'-UUAUUAGUUUGCUCCAAGUAUGACUGU-3'  (SEQ ID NO: 2168)
                    3'-AAUAAUCAAACGAGGUUCAUACUGACA-5'  (SEQ ID NO: 593)
MCL1-m2678 Target:  5'-TTATTAGTTTGCTCCAAGTATGACTGT-3'  (SEQ ID NO: 908)

5'-UUCACUUAAGUUUAGAGAAACACUGGG-3'  (SEQ ID NO: 2169)
                    3'-AAGUGAAUUCAAAUCUCUUUGUGACCC-5'  (SEQ ID NO: 594)
MCL1-m2706 Target:  5'-TTCACTTAAGTTTAGAGAAACACTGGG-3'  (SEQ ID NO: 909)

5'-CCACUGGUAACUGAAGGUAUUUAAGCU-3'  (SEQ ID NO: 2170)
                    3'-GGUGACCAUUGACUUCCAUAAAUUCGA-5'  (SEQ ID NO: 595)
MCL1-m2758 Target:  5'-CCACTGGTAACTGAAGGTATTTAAGCT-3'  (SEQ ID NO: 910)

5'-CAGCCUCAGAAUGUGACCUUUAGUCAG-3'  (SEQ ID NO: 2171)
                    3'-GUCGGAGUCUUACACUGGAAAUCAGUC-5'  (SEQ ID NO: 596)
MCL1-m2803 Target:  5'-CAGCCTCAGAATGTGACCTTTAGTCAG-3'  (SEQ ID NO: 911)

5'-AAUAGGCAGGAAUCAAAUGACUAAGAA-3'  (SEQ ID NO: 2172)
                    3'-UUAUCCGUCCUUAGUUUACUGAUUCUU-5'  (SEQ ID NO: 597)
MCL1-m2843 Target:  5'-AATAGGCAGGAATCAAATGACTAAGAA-3'  (SEQ ID NO: 912)

5'-AUAGGCAGGAAUCAAAUGACUAAGAAU-3'  (SEQ ID NO: 2173)
                    3'-UAUCCGUCCUUAGUUUACUGAUUCUUA-5'  (SEQ ID NO: 598)
MCL1-m2844 Target:  5'-ATAGGCAGGAATCAAATGACTAAGAAT-3'  (SEQ ID NO: 913)

5'-UAGGCAGGAAUCAAAUGACUAAGAAUG-3'  (SEQ ID NO: 2174)
                    3'-AUCCGUCCUUAGUUUACUGAUUCUUAC-5'  (SEQ ID NO: 599)
MCL1-m2845 Target:  5'-TAGGCAGGAATCAAATGACTAAGAATG-3'  (SEQ ID NO: 914)

5'-AGGCAGGAAUCAAAUGACUAAGAAUGU-3'  (SEQ ID NO: 2175)
                    3'-UCCGUCCUUAGUUUACUGAUUCUUACA-5'  (SEQ ID NO: 600)
MCL1-m2846 Target:  5'-AGGCAGGAATCAAATGACTAAGAATGT-3'  (SEQ ID NO: 915)

5'-GGCAGGAAUCAAAUGACUAAGAAUGUA-3'  (SEQ ID NO: 2176)
                    3'-CCGUCCUUAGUUUACUGAUUCUUACAU-5'  (SEQ ID NO: 601)
MCL1-m2847 Target:  5'-GGCAGGAATCAAATGACTAAGAATGTA-3'  (SEQ ID NO: 916)

5'-GCAGGAAUCAAAUGACUAAGAAUGUAA-3'  (SEQ ID NO: 2177)
                    3'-CGUCCUUAGUUUACUGAUUCUUACAUU-5'  (SEQ ID NO: 602)
MCL1-m2848 Target:  5'-GCAGGAATCAAATGACTAAGAATGTAA-3'  (SEQ ID NO: 917)

5'-CAGGAAUCAAAUGACUAAGAAUGUAAU-3'  (SEQ ID NO: 2178)
                    3'-GUCCUUAGUUUACUGAUUCUUACAUUA-5'  (SEQ ID NO: 603)
MCL1-m2849 Target:  5'-CAGGAATCAAATGACTAAGAATGTAAT-3'  (SEQ ID NO: 918)

5'-AGGAAUCAAAUGACUAAGAAUGUAAUA-3'  (SEQ ID NO: 2179)
                    3'-UCCUUAGUUUACUGAUUCUUACAUUAU-5'  (SEQ ID NO: 604)
MCL1-m2850 Target:  5'-AGGAATCAAATGACTAAGAATGTAATA-3'  (SEQ ID NO: 919)

5'-AUGACUAAGAAUGUAAUAGGGAAGAAG-3'  (SEQ ID NO: 2180)
                    3'-UACUGAUUCUUACAUUAUCCCUUCUUC-5'  (SEQ ID NO: 605)
MCL1-m2859 Target:  5'-ATGACTAAGAATGTAATAGGGAAGAAG-3'  (SEQ ID NO: 920)

5'-CUGCCAGCUUGGGAGUGAUUUGUACCU-3'  (SEQ ID NO: 2181)
                    3'-GACGGUCGAACCCUCACUAAACAUGGA-5'  (SEQ ID NO: 606)
MCL1-m2894 Target:  5'-CTGCCAGCTTGGGAGTGATTTGTACCT-3'  (SEQ ID NO: 921)

5'-AUCCUUGAUCAUAGUUUGCUUAUUUAU-3'  (SEQ ID NO: 2182)
                    3'-UAGGAACUAGUAUCAAACGAAUAAAUA-5'  (SEQ ID NO: 607)
MCL1-m2929 Target:  5'-ATCCTTGATCATAGTTTGCTTATTTAT-3'  (SEQ ID NO: 922)

5'-AGAGCACUUUAUGUAGUUGAAUAAACC-3'  (SEQ ID NO: 2183)
                    3'-UCUCGUGAAAUACAUCAACUUAUUUGG-5'  (SEQ ID NO: 608)
MCL1-m2975 Target:  5'-AGAGCACTTTATGTAGTTGAATAAACC-3'  (SEQ ID NO: 923)
```

TABLE 10-continued

Selected Mouse Anti-MCL1 "Blunt/Blunt" DsiRNAs

|  |  |  |
|---|---|---|
| MCL1-m2976 Target: | 5'-GAGCACUUUAUGUAGUUGAAUAAACCC-3'<br>3'-CUCGUGAAAUACAUCAACUUAUUUGGG-5'<br>5'-GAGCACTTTATGTAGTTGAATAAACCC-3' | (SEQ ID NO: 2184)<br>(SEQ ID NO: 609)<br>(SEQ ID NO: 924) |
| MCL1-m3055 Target: | 5'-UUUGUUUACUAGGAGCCUGACUUCCCA-3'<br>3'-AAACAAAUGAUCCUCGGACUGAAGGGU-5'<br>5'-TTTGTTTACTAGGAGCCTGACTTCCCA-3' | (SEQ ID NO: 2185)<br>(SEQ ID NO: 610)<br>(SEQ ID NO: 925) |
| MCL1-m3068 Target: | 5'-AGCCUGACUUCCCAGCUCACAAAGGGU-3'<br>3'-UCGGACUGAAGGGUCGAGUGUUUCCCA-5'<br>5'-AGCCTGACTTCCCAGCTCACAAAGGGT-3' | (SEQ ID NO: 2186)<br>(SEQ ID NO: 611)<br>(SEQ ID NO: 926) |
| MCL1-m3069 Target: | 5'-GCCUGACUUCCCAGCUCACAAAGGGUG-3'<br>3'-CGGACUGAAGGGUCGAGUGUUUCCCAC-5'<br>5'-GCCTGACTTCCCAGCTCACAAAGGGTG-3' | (SEQ ID NO: 2187)<br>(SEQ ID NO: 612)<br>(SEQ ID NO: 927) |
| MCL1-m3070 Target: | 5'-CCUGACUUCCCAGCUCACAAAGGGUGA-3'<br>3'-GGACUGAAGGGUCGAGUGUUUCCCACU-5'<br>5'-CCTGACTTCCCAGCTCACAAAGGGTGA-3' | (SEQ ID NO: 2188)<br>(SEQ ID NO: 613)<br>(SEQ ID NO: 928) |
| MCL1-m3077 Target: | 5'-UCCCAGCUCACAAAGGGUGAAAUGAAA-3'<br>3'-AGGGUCGAGUGUUUCCCACUUUACUUU-5'<br>5'-TCCCAGCTCACAAAGGGTGAAATGAAA-3' | (SEQ ID NO: 2189)<br>(SEQ ID NO: 614)<br>(SEQ ID NO: 929) |
| MCL1-m3081 Target: | 5'-AGCUCACAAAGGGUGAAAUGAAAGCUG-3'<br>3'-UCGAGUGUUUCCCACUUUACUUUCGAC-5'<br>5'-AGCTCACAAAGGGTGAAATGAAAGCTG-3' | (SEQ ID NO: 2190)<br>(SEQ ID NO: 615)<br>(SEQ ID NO: 930) |
| MCL1-m3104 Target: | 5'-GCUGAAGUACAGACAGGAUCUUAGUAG-3'<br>3'-CGACUUCAUGUCUGUCCUAGAAUCAUC-5'<br>5'-GCTGAAGTACAGACAGGATCTTAGTAG-3' | (SEQ ID NO: 2191)<br>(SEQ ID NO: 616)<br>(SEQ ID NO: 931) |
| MCL1-m3107 Target: | 5'-GAAGUACAGACAGGAUCUUAGUAGGUA-3'<br>3'-CUUCAUGUCUGUCCUAGAAUCAUCCAU-5'<br>5'-GAAGTACAGACAGGATCTTAGTAGGTA-3' | (SEQ ID NO: 2192)<br>(SEQ ID NO: 617)<br>(SEQ ID NO: 932) |
| MCL1-m3145 Target: | 5'-GGGCCAUGAAGACUUGGAGAGCGCAGU-3'<br>3'-CCCGGUACUUCUGAACCUCUCGCGUCA-5'<br>5'-GGGCCATGAAGACTTGGAGAGCGCAGT-3' | (SEQ ID NO: 2193)<br>(SEQ ID NO: 618)<br>(SEQ ID NO: 933) |
| MCL1-m3189 Target: | 5'-CUUUGGAGGGAAGAAGCAUGUGGUCUG-3'<br>3'-GAAACCUCCCUUCUUCGUACACCAGAC-5'<br>5'-CTTTGGAGGGAAGAAGCATGTGGTCTG-3' | (SEQ ID NO: 2194)<br>(SEQ ID NO: 619)<br>(SEQ ID NO: 934) |
| MCL1-m3214 Target: | 5'-UGAGUGCUGACUAGAUGAAUAGUUGAG-3'<br>3'-ACUCACGACUGAUCUACUUAUCAACUC-5'<br>5'-TGAGTGCTGACTAGATGAATAGTTGAG-3' | (SEQ ID NO: 2195)<br>(SEQ ID NO: 620)<br>(SEQ ID NO: 935) |
| MCL1-m3219 Target: | 5'-GCUGACUAGAUGAAUAGUUGAGGCACA-3'<br>3'-CGACUGAUCUACUUAUCAACUCCGUGU-5'<br>5'-GCTGACTAGATGAATAGTTGAGGCACA-3' | (SEQ ID NO: 2196)<br>(SEQ ID NO: 621)<br>(SEQ ID NO: 936) |
| MCL1-m3237 Target: | 5'-UGAGGCACAUCCUUCAGAGAAGAGGGA-3'<br>3'-ACUCCGUGUAGGAAGUCUCUUCUCCCU-5'<br>5'-TGAGGCACATCCTTCAGAGAAGAGGGA-3' | (SEQ ID NO: 2197)<br>(SEQ ID NO: 622)<br>(SEQ ID NO: 937) |
| MCL1-m3238 Target: | 5'-GAGGCACAUCCUUCAGAGAAGAGGAG-3'<br>3'-CUCCGUGUAGGAAGUCUCUUCUCCCUC-5'<br>5'-GAGGCACATCCTTCAGAGAAGAGGAG-3' | (SEQ ID NO: 2198)<br>(SEQ ID NO: 623)<br>(SEQ ID NO: 938) |
| MCL1-m3265 Target: | 5'-GGGCUGCUUGGAAAGAUGGCUCUCAGC-3'<br>3'-CCCGACGAACCUUUCUACCGAGAGUCG-5'<br>5'-GGGCTGCTTGGAAAGATGGCTCTCAGC-3' | (SEQ ID NO: 2199)<br>(SEQ ID NO: 624)<br>(SEQ ID NO: 939) |
| MCL1-m3294 Target: | 5'-AAUCUGUUUGUCUUACACGUCUCUCAG-3'<br>3'-UUAGACAAACAGAAUGUGCAGAGAGUC-5'<br>5'-AATCTGTTTGTCTTACACGTCTCTCAG-3' | (SEQ ID NO: 2200)<br>(SEQ ID NO: 625)<br>(SEQ ID NO: 940) |
| MCL1-m3340 Target: | 5'-CAAGCAUCUUCCAUGUACAUUCUAUCU-3'<br>3'-GUUCGUAGAAGGUACAUGUAAGAUAGA-5'<br>5'-CAAGCATCTTCCATGTACATTCTATCT-3' | (SEQ ID NO: 2201)<br>(SEQ ID NO: 626)<br>(SEQ ID NO: 941) |
| MCL1-m3390 Target: | 5'-GAGCACCUAACACUUUAACAGCUGUUC-3'<br>3'-CUCGUGGAUUGUGAAAUUGUCGACAAG-5'<br>5'-GAGCACCTAACACTTTAACAGCTGTTC-3' | (SEQ ID NO: 2202)<br>(SEQ ID NO: 627)<br>(SEQ ID NO: 942) |

TABLE 10-continued

Selected Mouse Anti-MCL1 "Blunt/Blunt" DsiRNAs

|  |  |  |
|---|---|---|
| | 5'-ACAGCUGUUCCCGAAAGGGUUAGGACC-3' | (SEQ ID NO: 2203) |
| | 3'-UGUCGACAAGGGCUUUCCCAAUCCUGG-5' | (SEQ ID NO: 628) |
| MCL1-m3407 Target: | 5'-ACAGCTGTTCCCGAAAGGGTTAGGACC-3' | (SEQ ID NO: 943) |
| | 5'-CCCGAAAGGGUUAGGACCAACUGCAAG-3' | (SEQ ID NO: 2204) |
| | 3'-GGGCUUUCCCAAUCCUGGUUGACGUUC-5' | (SEQ ID NO: 629) |
| MCL1-m3416 Target: | 5'-CCCGAAAGGGTTAGGACCAACTGCAAG-3' | (SEQ ID NO: 944) |
| | 5'-GACCAACUGCAAGUUAAUGUGGGUUGU-3' | (SEQ ID NO: 2205) |
| | 3'-CUGGUUGACGUUCAAUUACACCCAACA-5' | (SEQ ID NO: 630) |
| MCL1-m3430 Target: | 5'-GACCAACTGCAAGTTAATGTGGGTTGT-3' | (SEQ ID NO: 945) |
| | 5'-CCCUGGAAGAGUCACUGUCUGAAUGAA-3' | (SEQ ID NO: 2877) |
| | 3'-GGGACCUUCUCAGUGACAGACUUACUU-5' | (SEQ ID NO: 2397) |
| MCL1-m1355 Target: | 5'-CCCTGGAAGAGTCACTGTCTGAATGAA-3' | (SEQ ID NO: 2493) |

Within Tables 2-5 and 7-10 above, underlined residues indicate 2'-O-methyl residues, UPPER CASE indicates ribonucleotides, and lower case denotes deoxyribonucleotides. The DsiRNA agents of Tables 2-5 above are 25/27mer agents possessing a blunt end. The structures and/or modification patterning of the agents of Tables 2-5 and 7-10 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of MCL1 expression. Similarly, the 27mer "blunt/fray" and "blunt/blunt" DsiRNA structures and/or modification patterns of the agents of Tables 7-10 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the MCL1 transcript as the asymmetric "25/27" structures shown in Tables 2-3 herein. Exemplary "27/27" DsiRNAs are optionally designed with a "blunt/fray" structure as shown for the DsiRNAs of Tables 7-8 above, or with a "blunt/blunt" structure as shown for the DsiRNAs of Tables 9-10 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., MCL1 mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target MCL1 RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target MCL1 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target MCL1 RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target MCL1 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target MCL1 RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target MCL1 RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target MCL1 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target MCL1 RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target MCL1 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target MCL1 RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target MCL1 RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

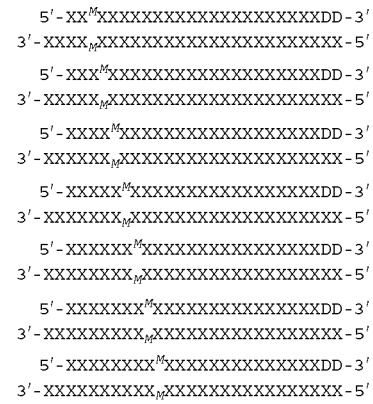

wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target MCL1 RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target MCL1 RNA (which, in certain embodiments, may be advantageous in promoting efficacy and/or potency and/or duration of effect). In certain embodiments, where mismatches occur between antisense strand and target MCL1 RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

```
Target RNA Sequence:      5'-...AXXXXXXXXXXXXXXXXXXX....-3'
DsiRNAmm Sense Strand:    5'-XXXXXXXXXXXXXXXXXXXXXXXDD-3'
DsiRNAmm Antisense Strand: 3'-EXXXXXXXXXXXXXXXXXXXXXXXXX-5'

Target RNA Sequence:      5'-...XAXXXXXXXXXXXXXXXXXX....-3'
DsiRNAmm Sense Strand:    5'-XXXXXXXXXXXXXXXXXXXXXXXDD-3'
DsiRNAmm Antisense Strand: 3'-XEXXXXXXXXXXXXXXXXXXXXXXXX-5'

Target RNA Sequence:      5'-...AXXXXXXXXXXXXXXXXXXX....-3'
DsiRNAmm Sense Strand:    5'-BXXXXXXXXXXXXXXXXXXXXXXDD-3'
DsiRNAmm Antisense Strand: 3'-XXEXXXXXXXXXXXXXXXXXXXXXXX-5'

Target RNA Sequence:      5'-...XAXXXXXXXXXXXXXXXXX....-3'
DsiRNAmm Sense Strand:    5'-XBXXXXXXXXXXXXXXXXXXXXXDD-3'
DsiRNAmm Antisense Strand: 3'-XXXEXXXXXXXXXXXXXXXXXXXXXXX-5'

Target RNA Sequence:      5'-...XXAXXXXXXXXXXXXXXXXX....-3'
DsiRNAmm Sense Strand:    5'-XXBXXXXXXXXXXXXXXXXXXXXDD-3'
DsiRNAmm Antisense Strand: 3'-XXXXEXXXXXXXXXXXXXXXXXXXXXX-5'

Target RNA Sequence:      5'-...XXXAXXXXXXXXXXXXXXXX....-3'
DsiRNAmm Sense Strand:    5'-XXXBXXXXXXXXXXXXXXXXXXXDD-3'
DsiRNAmm Antisense Strand: 3'-XXXXXEXXXXXXXXXXXXXXXXXXXXX-5'

Target RNA Sequence:      5'-...XXXXAXXXXXXXXXXXXXXX....-3'
DsiRNAmm Sense Strand:    5'-XXXXBXXXXXXXXXXXXXXXXXXDD-3'
DsiRNAmm Antisense Strand: 3'-XXXXXXEXXXXXXXXXXXXXXXXXXXX-5'

Target RNA Sequence:      5'-...XXXXXAXXXXXXXXXXXXXX....-3'
DsiRNAmm Sense Strand:    5'-XXXXXBXXXXXXXXXXXXXXXXXDD-3'
DsiRNAmm Antisense Strand: 3'-XXXXXXXEXXXXXXXXXXXXXXXXXXX-5'

Target RNA Sequence:      5'-...XXXXXXAXXXXXXXXXXXXX....-3'
DsiRNAmm Sense Strand:    5'-XXXXXXBXXXXXXXXXXXXXXXXDD-3'
DsiRNAmm Antisense Strand: 3'-XXXXXXXXEXXXXXXXXXXXXXXXXXX-5'

Target RNA Sequence:      5'-...XXXXXXXAXXXXXXXXXXXX....-3'
DsiRNAmm Sense Strand:    5'-XXXXXXXBXXXXXXXXXXXXXXXDD-3'
DsiRNAmm Antisense Strand: 3'-XXXXXXXXXEXXXXXXXXXXXXXXXXX-5'

Target RNA Sequence:      5'-...XXXXXXXXAXXXXXXXXXXX....-3'
DsiRNAmm Sense Strand:    5'-XXXXXXXXBXXXXXXXXXXXXXXDD-3'
DsiRNAmm Antisense Strand: 3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl In addition to the above-exemplified structures, dsRNAs of the invention can also possess one, two or three additional residues that form further mismatches with the target MCL1 RNA sequence. Such mismatches can be consecutive, or can be interspersed by nucleotides that form matched base pairs with the target MCL1 RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target MCL1 RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target MCL1 RNA sequence) of the antisense strand of a DsiRNAmm is the nucleotide residue of the antisense strand that is located immediately 3' (downstream) within the antisense strand sequence of the projected Ago2 cleavage site of the corresponding target MCL1 RNA sequence. In other preferred embodiments, a mismatch nucleotide of the antisense strand of a DsiRNAmm (in relation to the target MCL1 RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target MCL1 RNA sequence), mismatches can occur consecutively (e.g., at consecutive positions along the antisense strand nucleotide sequence). Alternatively, nucleotides of the antisense strand that form mismatched base pairs with the target MCL1 RNA sequence can be interspersed by nucleotides that base pair with the target MCL1 RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target MCL1 RNA sequence). For example, two residues of the antisense strand (located within the mismatch-tolerant region of the antisense strand) that form mismatched base pairs with the corresponding target MCL1 RNA sequence can occur with zero, one, two, three, four or five matched base pairs (with respect to target MCL1 RNA sequence) located between these mismatch-forming base pairs.

For certain dsRNAs possessing three mismatch-forming base pairs (mismatch-forming with respect to target MCL1 RNA sequence), mismatch-forming nucleotides can occur consecutively (e.g., in a triplet along the antisense strand nucleotide sequence). Alternatively, nucleotides of the antisense strand that form mismatched base pairs with the target MCL1 RNA sequence can be interspersed by nucleotides that form matched base pairs with the target MCL1 RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target MCL1 RNA). For example, three residues of the antisense strand (located within the mismatch-tolerant region of the antisense strand) that form mismatched base pairs with the corresponding target MCL1 RNA sequence can occur with zero, one, two, three or four matched base pairs located between any two of these mismatch-forming base pairs.

For certain dsRNAs possessing four mismatch-forming base pairs (mismatch-forming with respect to target MCL1 RNA sequence), mismatch-forming nucleotides can occur consecutively (e.g., in a quadruplet along the sense strand nucleotide sequence). Alternatively, nucleotides of the antisense strand that form mismatched base pairs with the target MCL1 RNA sequence can be interspersed by nucleotides that form matched base pairs with the target MCL1 RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target MCL1 RNA sequence—similarly, the mismatch-forming residues of antisense strand positions 19 and 21 are also interspersed by one nucleotide that forms a matched base pair with the corresponding residue of the target MCL1 RNA sequence). For example, four residues of the antisense strand (located within the mismatch-tolerant region of the antisense strand) that form mismatched base pairs with the corresponding target MCL1 RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target MCL1 RNA-aligned structures. Accordingly, the dsRNAs of the invention can be designed to possess in/del variations in, e.g., antisense strand sequence as compared to target MCL1 RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:      5'-...XXXXXXXXXXXXXXXXXXXXXXHXXX...-3'
DsiRNA Sense Strand:      5'-XXXXXXXXXXXXXXXXXXXXXIXDD-3'
DsiRNA Antisense Strand:  3'-XXXXXXXXXXXXXXXXXXXXXXXJXXX-5'

Target RNA Sequence:      5'-...XXXXXXXXXXXXXXXXXXXXXHXX...-3'
DsiRNA Sense Strand:      5'-XXXXXXXXXXXXXXXXXXXXXXIDD-3'
DsiRNA Antisense Strand:  3'-XXXXXXXXXXXXXXXXXXXXXXXJXX-5'

Target RNA Sequence:      5'-...XXXXXXXXXXXXXXXXXXXXXHX...-3'
DsiRNA Sense Strand:      5'-XXXXXXXXXXXXXXXXXXXXXXXID-3'
DsiRNA Antisense Strand:  3'-XXXXXXXXXXXXXXXXXXXXXXXJX-5'

Target RNA Sequence:      5'-...XXXXXXXXXXXXXXXXXXXXXXH...-3'
DsiRNA Sense Strand:      5'-XXXXXXXXXXXXXXXXXXXXXXXDI-3'
DsiRNA Antisense Strand:  3'-XXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers— alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric MCL1-1916 DsiRNA (newly-introduced mismatch residues are italicized):

MCL1-1916 25/27mer DsiRNA, mismatch position=22 of sense strand (from 5'-terminus)

```
5'-GAAAGUCUAUUUCUUUGAAAC^A Aag-3'        (SEQ ID NO: 2882)
3'-GUCUUUCAGAUAAAGAAACUUUG_C UUC-5'      (SEQ ID NO: 439)
```

Optionally, the mismatched "A" residue of position 22 of the sense strand is alternatively "U" or "C".

MCL1-1916 25/27mer DsiRNA, mismatch position=23 of sense strand

```
5'-GAAAGUCUAUUUCUUUGAAACG^C ag-3'        (SEQ ID NO: 2883)
3'-GUCUUUCAGAUAAAGAAACUUUGC_U UC-5'      (SEQ ID NO: 439)
```

Optionally, the mismatched "C" residue of position 23 of the sense strand is alternatively "G" or "U".

MCL1-1916 25/27mer DsiRNA, mismatch position=24 of sense strand

```
5'-GAAAGUCUAUUUCUUUGAAACGA^c g-3'        (SEQ ID NO: 2884)
3'-GUCUUUCAGAUAAAGAAACUUUGCU_U C-5'      (SEQ ID NO: 439)
```

Optionally, the mismatched "c" residue of position 24 of the sense strand is alternatively "g" or "t".

MCL1-1916 25/27mer DsiRNA, mismatch position=25 of sense strand

```
5'-GAAAGUCUAUUUCUUUGAAACGAa^a-3'         (SEQ ID NO: 2885)
3'-GUCUUUCAGAUAAAGAAACUUUGCUU_C-5'       (SEQ ID NO: 439)
```

Optionally, the mismatched "a" residue of position 25 of the sense strand is alternatively "t" or "c".

MCL1-1916 25/27mer DsiRNA, mismatch position=1 of antisense strand

```
5'-GAAAGUCUAUUUCUUUGAAACGAa^g-3'         (SEQ ID NO: 124)
3'-GUCUUUCAGAUAAAGAAACUUUGCUU_A-5'       (SEQ ID NO: 2886)
```

Optionally, the mismatched "A" residue of position 1 of the antisense strand is alternatively "G" or "U".

MCL1-1916 25/27mer DsiRNA, mismatch position=2 of antisense strand

```
5'-GAAAGUCUAUUUCUUUGAAACGA^a g-3'        (SEQ ID NO: 124)
3'-GUCUUUCAGAUAAAGAAACUUUGCU_C C-5'      (SEQ ID NO: 2887)
```

Optionally, the mismatched "C" residue of position 2 of the antisense strand is alternatively "G" or "A".

MCL1-1916 25/27mer DsiRNA, mismatch position=3 of antisense strand

```
5'-GAAAGUCUAUUUCUUUGAAACG^A ag-3'        (SEQ ID NO: 124)
3'-GUCUUUCAGAUAAAGAAACUUUGC_C UC-5'      (SEQ ID NO: 2888)
```

Optionally, the mismatched "C" residue of position 3 of the antisense strand is alternatively "A" or "G".

MCL1-1916 25/27mer DsiRNA, mismatch position=4 of antisense strand

```
5'-GAAAGUCUAUUUCUUUGAAAC^G Aag-3'        (SEQ ID NO: 124)
3'-GUCUUUCAGAUAAAGAAACUUUG_A UUC-5'      (SEQ ID NO: 2889)
```

Optionally, the mismatched "A" residue of position 4 of the antisense strand is alternatively "U" or "G".

As an additional example, in the below structures, such mismatches are introduced within the asymmetric MCL1-1948 DsiRNA (newly-introduced mismatch residues are italicized):

MCL1-1948 25/27mer DsiRNA, mismatch position=22 of sense strand (from 5'-terminus)

```
5'-CGAAUUUACAUUAGUUUUUUU^AAta-3'      (SEQ ID NO: 2966)
3'-UAGCUUAAAUGUAAUCAAAAAAA_GUAU-5'    (SEQ ID NO: 441)
```

Optionally, the mismatched "A" residue of position 22 of the sense strand is alternatively "U" or "G".
MCL1-1948 25/27mer DsiRNA, mismatch position=23 of sense strand

```
5'-CGAAUUUACAUUAGUUUUUUUC^Cta-3'      (SEQ ID NO: 2967)
3'-UAGCUUAAAUGUAAUCAAAAAAAG_UAU-5'    (SEQ ID NO: 441)
```

Optionally, the mismatched "C" residue of position 23 of the sense strand is alternatively "G" or "U".
MCL1-1948 25/27mer DsiRNA, mismatch position=24 of sense strand

```
5'-CGAAUUUACAUUAGUUUUUUUCA^Ca-3'      (SEQ ID NO: 2968)
3'-UAGCUUAAAUGUAAUCAAAAAAAGU_AU-5'    (SEQ ID NO: 441)
```

Optionally, the mismatched "c" residue of position 24 of the sense strand is alternatively "g" or "a".
MCL1-1948 25/27mer DsiRNA, mismatch position=25 of sense strand

```
5'-CGAAUUUACAUUAGUUUUUUUCAt^C-3'      (SEQ ID NO: 2969)
3'-UAGCUUAAAUGUAAUCAAAAAAAGUA_U-5'    (SEQ ID NO: 441)
```

Optionally, the mismatched "c" residue of position 25 of the sense strand is alternatively "t" or "g".
MCL1-1948 25/27mer DsiRNA, mismatch position=1 of antisense strand

```
5'-CGAAUUUACAUUAGUUUUUUUCAt^a-3'      (SEQ ID NO: 126)
3'-UAGCUUAAAUGUAAUCAAAAAAAGUA_C-5'    (SEQ ID NO: 2970)
```

Optionally, the mismatched "C" residue of position 1 of the antisense strand is alternatively "G" or "A".
MCL1-1948 25/27mer DsiRNA, mismatch position=2 of antisense strand

```
5'-CGAAUUUACAUUAGUUUUUUUCA^ta-3'      (SEQ ID NO: 126)
3'-UAGCUUAAAUGUAAUCAAAAAAAGU_CU-5'    (SEQ ID NO: 2971)
```

Optionally, the mismatched "C" residue of position 2 of the antisense strand is alternatively "G" or "UI".
MCL1-1948 25/27mer DsiRNA, mismatch position=3 of antisense strand

```
5'-CGAAUUUACAUUAGUUUUUUUC^Ata-3'      (SEQ ID NO: 126)
3'-UAGCUUAAAUGUAAUCAAAAAAAG_CAU-5'    (SEQ IS NO: 2972)
```

Optionally, the mismatched "C" residue of position 3 of the antisense strand is alternatively "A" or "G".

MCL1-1948 25/27mer DsiRNA, mismatch position=4 of antisense strand

```
5'-CGAAUUUACAUUAGUUUUUUU^CAta-3'      (SEQ ID NO: 126)
3'-UAGCUUAAAUGUAAUCAAAAAAA_AUAU-5'    (SEQ ID NO: 2973)
```

Optionally, the mismatched "A" residue of position 4 of the antisense strand is alternatively "U" or "C".

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary MCL1-1916 DsiRNA sequence):

```
                                              (SEQ ID NO: 2890)
        5'-GAAAGUCUAUUUCUUUGAAACXXX[X]_n-3'

(SEQ ID NO: 2891)
        3'-GUCUUUCAGAUAAAGAAACUUXXXXX[X]_n-5'
``` where n=1 to 5, 1 to 10, 1 to 20, 1 to 30, 1 to 50, or 1 to 80 or more.
MCL1-1916 Target: 5'-CAGAAAGTCTATTTCTTT-GAAXXXXXX-3' (SEQ ID NO: 2892)

The MCL1 target site may also be a site which is targeted by one or more of several oligonucleotides whose complementary target sites overlap with a stated target site. For example, for an exemplary MCL1-1916 DsiRNA, it is noted that certain DsiRNAs targeting overlapping and only slightly offset MCL1 sequences can exhibit activity levels similar to that of MCL1-1916 (specifically, see MCL1-1914 to MCL1-1916 of Table 11 below. Thus, in certain embodiments, a designated target sequence region can be effectively targeted by a series of DsiRNAs possessing largely overlapping sequences. (E.g., if considering DsiRNAs surrounding the MCL1-1916 site, a more encompassing MCL1 target sequence might be recited as, e.g., 5'-TACAGAAAGTC-TATTTCTTTGAAACGAAG-3' (SEQ ID NO: 2893), wherein any given DsiRNA (e.g., a DsiRNA selected from MCL1-1914 to MCL1-1916) only targets a sub-sequence within such a sequence region, yet the entire sequence can be considered a viable target for such a series of DsiRNAs).

Additionally and/or alternatively, mismatches within the 3'-terminal four nucleotides of the sense strand/5'-terminal four nucleotides of the antisense strand can be combined with mismatches positioned at other mismatch-tolerant positions, as described above.

In view of the present identification of the above-described Dicer substrate agents (DsiRNAs) as inhibitors of MCL1 levels via targeting of specific MCL1 sequences, it is also recognized that dsRNAs having structures similar to those described herein can also be synthesized which target other sequences within the MCL1 sequence of NM_021960.3, NM_182763.2, NM_00 197320.1 or NM_008562.3, or within variants thereof (e.g., target sequences possessing 80% identity, 90% identity, 95% identity, 96% identity, 97% identity, 98% identity, 99% or more identity to a sequence of NM_021960.3, NM_182763.2, NM_001197320.1 and/or NM_008562.3).

Anti-MCL1 DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., MCL1 RNA) of or derived from the target gene, MCL1 (or other gene associated with a MCL1-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-MCL1 DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-MCL1 dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev*, 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem*, 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-MCL1 dsRNA agents of the present invention so long as the modification does not prevent the dsRNA agent from possessing MCL1 inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective MCL1 inhibition (as described herein, MCL1 inhibition/MCL1 inhibitory activity of a dsRNA can be assayed via art-recognized methods for determining RNA levels, or for determining MCL1 polypeptide levels, should such levels be assessed in lieu of or in addition to assessment of, e.g., MCL1 mRNA levels). In a third embodiment, one or more modifications are made that support greater MCL1 inhibitory activity (means of determining MCL1 inhibitory activity are described supra). In a fourth embodiment, one or more modifications are made that result in greater potency of MCL1 inhibitory activity per each dsRNA agent molecule to be delivered to the cell (potency of MCL1 inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-MCL1 DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target MCL1 RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-MCL1 DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that MCL1 inhibitory activity of the DsiRNA possessing mismatched base pairs is retained at sufficient levels (e.g., retains at least 50% MCL1 inhibitory activity or more, at least 60% MCL1 inhibitory activity or more, at least 70% MCL1 inhibitory activity or more, at least 80% MCL1 inhibitory activity or more, at least 90% MCL1 inhibitory activity or more or at least 95% MCL1 inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance MCL1 inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue):W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the MCL1 RNA.

MCL1 cDNA and Polypeptide Sequences

Known human and mouse MCL1 cDNA and polypeptide sequences include the following: human MCL1 transcript variants 1 (NM_021960.3), 2 (NM_182763.2) and 3 (NM_001197320.1); corresponding human MCL1 polypeptide sequences GenBank Accession Nos. NP_068779.1 (transcript variant 1), NP_877495.1 (transcript variant 2), and NP_001184249.1 (transcript variant 3); mouse wild-type MCL1 sequence GenBank Accession No. NM_008562.3 (*Mus musculus* C57BL6 MCL1 transcript) and corresponding mouse MCL1 polypeptide sequence GenBank Accession No. NP_032588.1.

In Vitro Assay to Assess dsRNA MCL1 Inhibitory Activity

An in vitro assay that recapitulates RNAi in a cell-free system can be used to evaluate dsRNA constructs targeting MCL1 RNA sequence(s), and thus to assess MCL1-specific gene inhibitory activity (also referred to herein as MCL1 inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against MCL1 RNA. A *Drosophila* extract derived from syncytial blastoderm is used to reconstitute RNAi activity in vitro. Target RNA is generated via in vitro transcription from a selected MCL1 expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and pre-incubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [$\alpha$-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the MCL1 RNA target for dsRNA mediated RNAi cleavage, wherein a plurality of dsRNA constructs are screened for RNAi mediated cleavage of the MCL1 RNA target, for example, by analyzing the assay reaction by electrophoresis of labeled target RNA, or by northern blotting, as well as by other methodology well known in the art.

In certain embodiments, a dsRNA of the invention is deemed to possess MCL1 inhibitory activity if, e.g., a 50% reduction in MCL1 RNA levels is observed in a system, cell, tissue or organism, relative to a suitable control. Additional metes and bounds for determination of MCL1 inhibitory activity of a dsRNA of the invention are described supra.

Conjugation and Delivery of Anti-MCL1 dsRNA Agents

In certain embodiments the present invention relates to a method for treating a subject having a MCL1-associated disease or disorder, or at risk of developing a MCL1-associated disease or disorder. In such embodiments, the dsRNA can act as novel therapeutic agents for controlling the MCL1-associated disease or disorder. The method comprises administering a pharmaceutical composition of the invention to the patient (e.g., human), such that the expression, level and/or activity of a MCL1 RNA is reduced. The expression, level and/or activity of a polypeptide encoded by a MCL1 RNA might also be reduced by a dsRNA of the instant invention, even where said dsRNA is directed against a non-coding region of the MCL1 transcript (e.g., a targeted 5' UTR or 3' UTR sequence). Because of their high specificity, the dsRNAs of the present invention can specifically target MCL1 sequences of cells and tissues, optionally in an allele-specific manner where polymorphic alleles exist within an individual and/or population.

In the treatment of a MCL1-associated disease or disorder, the dsRNA can be brought into contact with the cells or tissue of a subject, e.g., the cells or tissue of a subject exhibiting disregulation of MCL1 and/or otherwise targeted for reduction of MCL1 levels. For example, dsRNA substantially identical to all or part of a MCL1 RNA sequence, may be brought into contact with or introduced into such a cell, either in vivo or in vitro. Similarly, dsRNA substantially identical to all or part of a MCL1 RNA sequence may administered directly to a subject having or at risk of developing a MCL1-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the MCL1 RNA, or that not only target MCL1 RNA but also target, e.g., cellular target genes associated with a MCL1-associated disease or disorder. A dsRNA agent of the instant invention may also be constructed such that either strand of the dsRNA agent independently targets two or more regions of MCL1 RNA, or such that one of the strands of the dsRNA agent targets a cellular target gene of MCL1 known in the art.

Use of multifunctional dsRNA molecules that target more then one region of a target nucleic acid molecule can also provide potent inhibition of MCL1 RNA levels and expression. For example, a single multifunctional dsRNA construct of the invention can target both the MCL1-1916 and MCL1-

1572 sites simultaneously; additionally and/or alternatively, single or multifunctional agents of the invention can be designed to selectively target one splice variant of MCL1 over another.

Thus, the dsRNA agents of the instant invention, individually, or in combination or in conjunction with other drugs, can be used to treat, inhibit, reduce, or prevent a MCL1-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a MCL1-associated disease or disorder in a subject or organism. For example, the described molecules could be used in combination with one or more known compounds, treatments, or procedures to treat, inhibit, reduce, or prevent a MCL1-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target MCL1 RNA.

A cell having a target MCL1 RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target MCL1 RNA sequence and the dose of dsRNA agent material delivered, this process may provide partial or complete loss of function for the MCL1 RNA. A reduction or loss of RNA levels or expression (either MCL1 RNA expression or encoded polypeptide expression) in at least 50%, 60%, 70%, 80%, 90%, 95% or 99% or more of targeted cells is exemplary. Inhibition of MCL1 RNA levels or expression refers to the absence (or observable decrease) in the level of MCL1 RNA or MCL1 RNA-encoded protein. Specificity refers to the ability to inhibit the MCL1 RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target MCL1 RNA sequence(s) by the dsRNA agents of the invention also can be measured based upon the effect of administration of such dsRNA agents upon development/progression of a MCL1-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyl-transferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target MCL1 RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

MCL1 Biology and Known MCL1-Targeting Therapeutics

MCL1 is a Bcl-2 family member. Alternative splicing occurs at the MCL1 locus and two transcript variants encoding distinct isoforms have been identified. The longer gene product (isoform 1) enhances cell survival by inhibiting apoptosis while the alternatively spliced shorter gene product (isoform 2) promotes apoptosis and is death-inducing. MCL1 has been shown to interact with BAK1, Noxa, BCL2L11, Bcl-2-associated death promoter, PCNA, DAD1, TNKS and BH3 interacting domain death agonist (Leu et al. Nat. Cell Biol. 6: 443-50; Willis et al. Genes Dev. 19: 1294-305; Weng et al. J. Biol. Chem. 280: 10491-500; Bae et al. J. Biol. Chem. 275: 25255-61; Chen et al. Mol. Cell 17: 393-403; Hsu et al. Mol. Endocrinol. 12: 1432-40; Bae et al. Apoptosis 6: 319-30; Fujise et al. J. Biol. Chem. 275: 39458-65; Makishima et al. J. Biochem. 128: 399-405; and Bae et al. J. Biol. Chem. 278: 5195-204).

Omacetaxine mepesuccinate is an inhibitor of Mcl-1 synthesis that is an investigational treatment for chronic myelogenous leukemia (CML).

The MCL1-inhibiting double stranded nucleic acids of the instant invention can be used alone, or in combination with any art-recognized MCL1-targeting therapeutic, such as that recited above.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or HI RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a MCL1 RNA can be determined by a suitable method now known in the art or that is later developed. It can be appreciated that the method used to measure a target RNA and/or the expression of a target RNA can depend upon the nature of the target RNA. For example, where the target MCL1 RNA sequence encodes a protein, the term "expression" can refer to a protein or the MCL1 RNA/transcript derived from the MCL1 gene (either genomic or of exogenous origin). In such instances the expression of the target MCL1 RNA can be determined by measuring the amount of MCL1 RNA/transcript directly or by measuring the amount of Mcl-1 protein. Protein can be measured in protein assays such as by staining or immunoblotting or, if the protein catalyzes a reaction that can be measured, by measuring reaction rates. All such methods are known in the art and can be used. Where target MCL1 RNA levels are to be measured, art-recognized methods for detecting RNA levels can be used (e.g., RT-PCR, Northern Blotting, etc.). In targeting MCL1 RNAs with the dsRNA agents of the instant invention, it is also anticipated that measurement of the efficacy of a dsRNA agent in reducing levels of MCL1 RNA or protein in a subject, tissue, in cells, either in vitro or in vivo, or in cell extracts can also be used to determine the extent of reduction of MCL1-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a MCL1 RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by MCL1 (e.g., misregulation and/or elevation of MCL1 transcript and/or Mcl-1 protein levels), or treatable via selective targeting of MCL1.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of MCL1 expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target MCL1 RNA molecules of the present invention or target MCL1 RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of MCL1 mRNA Levels and Expression Cell Culture The dsRNA agents of the invention can be tested for cleavage activity in vivo, for example, using the following procedure. The nucleotide sequences within the MCL1 cDNA targeted by the dsRNA agents of the invention are shown in the above MCL1 sequences.

The dsRNA reagents of the invention can be tested in cell culture using Huh7 or other mammalian cells to determine the extent of MCL1 RNA and Mcl-1 protein inhibition. In certain embodiments, DsiRNA reagents (e.g., see FIG. 1, and above-recited structures) are selected against the MCL1 target as described herein. MCL1 RNA inhibition is measured after delivery of these reagents by a suitable transfection agent to, for example, cultured Huh7 cells or other transformed or non-transformed mammalian cells in culture. Relative amounts of target MCL1 RNA are measured versus actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMMCL1A conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1× TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target MCL1 mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-MCL1 dsRNA agents may be evaluated in an animal model. Animal models of cancer and/or proliferative diseases, conditions, or disorders as are known in the art can be used for evaluation of the efficacy, potency, toxicity, etc. of anti-MCL1 dsRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of dsRNA compositions of the invention in modulating MCL1 gene expression toward therapeutic use.

As in cell culture models, the most MCL1 relevant mouse tumor xenografts are those derived from cancer cells that express Mcl-1 proteins. Xenograft mouse models of cancer relevant to study of the anti-tumor effect of modulating MCL1 have been described by various groups (e.g., Thallinger et al., J. Invest. Dermatol 2003 June; 120(6): 1081; Loberg R D et al., Neoplasia 2007 December; 9(12): 1030; Hikita H et al., Hepatology 2010 October; 52(4): 1310; Wei, J et al., J Med Chem 2010 May 27; 53(10): 4166). Use of these models has demonstrated that inhibition of MCL1 expression by anti-MCL1 agents causes inhibition of tumor growth in animals.

Such models can be used in evaluating the efficacy of dsRNA molecules of the invention to inhibit MCL1 levels, expression, tumor/cancer formation, growth, spread, development of other MCL1-associated phenotypes, diseases or disorders, etc. These models and others can similarly be used to evaluate the safety/toxicity and efficacy of dsRNA molecules of the invention in a pre-clinical setting.

Specific examples of animal model systems useful for evaluation of the MCL1-targeting dsRNAs of the invention include wild-type mice, and orthotopic or subcutaneous 518A2, MHCC97, A549, H1299, HepG2, SNU398, HuH7, NCI-H196, NCI-H1975, HT29, MKN-45, MDA-MB-231, NCI-H441, Panc-1, MiaPaCa, BxPC3, DU-145, M2182, VCaP, OvCar-3, MCF-7, U937, K562, HeLa, T98G, or SHP-77 tumor model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human MCL1 levels, depending upon the model used. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, in a first screen, 200 human target MCL1 sequences and 115 mouse target MCL1 sequences were selected for evaluation (61 of the 200 human target MCL1 sites were predicted to be conserved with corresponding sites in the mouse MCL1 transcript sequence). A second screen for active MCL1 targeting duplexes was also performed, and involved selection of 95 human MCL1 target sequences and one mouse MCL1 target sequence (seven of the human MCL1 target sequences of the second screen were identical to target sequences of the first screen, while 88 human target sequences were new, while the mouse MCL1 target sequence of the second screen was identical to a mouse MCL1 target sequence of the first screen; only three of the 95 human MCL1 target sequences of the second screen were predicted to be conserved with corresponding sites in the mouse MCL1 transcript sequence). The sequences of one strand of the DsiRNA molecules were complementary to the target MCL1 site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353, 098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 µm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 µM concentration in duplex buffer consisting of 100 mM potassium acetate, 30 mM HEPES, pH 7.5. Complementary sense and antisense strands were mixed in equal molar amounts to yield a final solution of, e.g., 50 µM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

Huh7 cells were obtained from ATCC and maintained in DMEM (HyClone) supplemented with 10% fetal bovine serum (HyClone) at 37° C. under 5% $CO_2$. Hepa 1-6 cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM, 0.3 nM or 0.1 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 150 µL (with 0.3 nM DsiRNA). The resulting 150 µL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 µL of the cell suspension were added to each well (final volume 150 µL) and plates were placed into the incubator for 24 hours.

Assessment of MCL1 Inhibition

MCL1 target gene knockdown was determined by qRT-PCR, with values normalized to HPRT and SFRS9 housekeeping genes (or, in Example 8 below, to HPRT only), and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the MCL1 gene and for the human genes HPRT-1 and SFRS9. An ABI 7700 was used for the amplification reactions. Each sample was tested in triplicate. Relative MCL1 RNA levels were normalized to HPRT1 and SFRS9 RNA levels and compared with RNA levels obtained in transfection control samples. For Example 8 below, total RNA was reverse-transcribed using Transcriptor First Strand cDNA Synthesis Kit (Roche) and random hexamers following manufacturer's instructions. The resulting cDNA was analyzed by qPCR using primers and probes specific for both the MCL1 gene and for the human gene HPRT-1. A Bio-Rad CFX96 was used for the amplification reactions. Each sample was tested in duplicate. Relative MCL1 RNA levels were normalized to HPRT1 RNA levels and compared with RNA levels obtained in mock transfection control samples.

Example 2: DsiRNA Inhibition of MCL1—First Primary Screen

DsiRNA molecules targeting MCL1 were designed and synthesized as described above and tested in human Huh7 cells or mouse Hepa 1-6 cells for inhibitory efficacy. For transfection, annealed DsiRNAs were mixed with the transfection reagent (Lipofectamine™ RNAiMAX, Invitrogen) and incubated for 20 minutes at room temperature. The Huh7 (human) or Hepa 1-6 (mouse) cells were trypsinized, resuspended in media, and added to wells (100 uL per well) to give a final DsiRNA concentration of 1 nM in a volume of 150 µl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target MCL1 RNA levels following treatment were evaluated by qRT-PCR for the MCL1 target gene, with values normalized to those obtained for controls. Triplicate data was averaged and the % error determined for each treatment Normalized data were graphed and the reduction of target mRNA by active DsiRNAs in comparison to controls was determined.

MCL1 targeting DsiRNAs examined for MCL1 inhibitory efficacy in an initial primary phase of testing are indicated in Table 11 below. In this example, 315 asymmetric DsiRNAs (tested DsiRNAs possessed a 25/27mer structure) were constructed and tested for MCL1 inhibitory efficacy in human Huh7 and mouse Hepa 1-6 cells incubated in the presence of such DsiRNAs at a concentration of 1 nM. The 315 asymmetric DsiRNAs tested in the initial primary screen included DsiRNAs selected from Tables 2 and 4 above that did not possess 2'-O-methyl modified residues, where sequences and structures of these tested asymmetric DsiRNAs are shown (in above Tables 2 and 4, underlined nucleotide residues indicate 2'-O-methyl modified residues, ribonucleotide residues are shown as UPPER CASE, and deoxyribonucleotide residues are shown as lower case).

Assay of the 315 MCL1 targeting DsiRNAs in human Huh7 and mouse Hepa 1-6 cells at 1 nM revealed the following MCL1 inhibitory efficacies, presented in Table 11. MCL1 levels were determined using qPCR assays positioned at indicated locations within the MCL1 transcript (for human Huh7 cell experiments, paired qPCR assays were performed and are indicated as "Hs MCL1 1456-1586" (MAX) and "Hs MCL1 2770-2871" (FAM); for mouse Hepa 1-6 cell experiments, paired qPCR assays were initially performed and are indicated as "Mm MCL1 558-675" (FAM) and "Mm MCL1 975-1131" (MAX), while an additional mouse assay, "Mm MCL1 2340-2593" (FAM) was subsequently added).

TABLE 11

MCL1 Inhibitory Efficacy of DsiRNAs Assayed at 1 nM in Human Huh7 Cells and Mouse Hepa 1-6 Cells - First Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) | Mouse Hepa 1-6 Cells % Remaining MCL1 mRNA ± % Error (Assays: Mm MCL1 558-675 (FAM) & 975-1131 (MAX)) | Mouse Hepa 1-6 Cells (New Assay) % Remaining MCL1 mRNA ± % Error (Assay: Mm MCL1 2340-2593 (FAM)) |
|---|---|---|---|---|
| MCL1-72 | | 94.7 ± 5.6 | | |
| MCL1-75 | | 89.1 ± 4.7 | | |
| MCL1-141 | | 104 ± 3.1 | | |
| MCL1-175 | | 83.1 ± 3.2 | | |
| MCL1-250 | | 55.8 ± 13.8 | | |
| MCL1-434 | | 60.4 ± 2.7 | | |
| MCL1-604 | | 75.3 ± 4.7 | | |
| MCL1-661 | | 76.3 ± 9.9 | | |
| MCL1-680 | | 26 ± 4.9 | | |
| MCL1-733 | | 65.4 ± 8.6 | | |
| MCL1-774 | | 61.8 ± 3.5 | | |
| MCL1-838 | | 75.2 ± 5.1 | | |
| MCL1-839 | | 28.9 ± 2.7 | | |
| MCL1-871 | | 40.4 ± 5.7 | | |
| MCL1-877 | | 47.2 ± 6.4 | | |
| MCL1-939 | | 32.2 ± 22.4 | | |
| MCL1-947 | | 59.4 ± 5 | | |
| MCL1-970 | | 40.4 ± 6.4 | | |
| MCL1-975 | | 66.5 ± 13.2 | | |

TABLE 11-continued

MCL1 Inhibitory Efficacy of DsiRNAs Assayed at 1 nM in Human Huh7 Cells and Mouse Hepa 1-6 Cells - First Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) | Mouse Hepa 1-6 Cells % Remaining MCL1 mRNA ± % Error (Assays: Mm MCL1 558-675 (FAM) & 975-1131 (MAX)) | Mouse Hepa 1-6 Cells (New Assay) % Remaining MCL1 mRNA ± % Error (Assay: Mm MCL1 2340-2593 (FAM)) |
|---|---|---|---|---|
| MCL1-976 | | 35.9 ± 5.5 | | |
| MCL1-977 | | 38.6 ± 14.9 | | |
| MCL1-978 | | 41 ± 4.5 | | |
| MCL1-984 | | 40.2 ± 10.4 | | |
| MCL1-985 | | 41.2 ± 6.3 | | |
| MCL1-990 | | 78.5 ± 13.8 | | |
| MCL1-1018 | | 39.5 ± 10.3 | | |
| MCL1-1062 | | 30.6 ± 12.7 | | |
| MCL1-1063 | | 41 ± 7.6 | | |
| MCL1-1070 | | 51.6 ± 12.4 | | |
| MCL1-1104 | | 64.9 ± 4.6 | | |
| MCL1-1111 | | 104.3 ± 5 | | |
| MCL1-1120 | | 53.3 ± 4.8 | | |
| MCL1-1163 | | 97.8 ± 3.9 | | |
| MCL1-1182 | | 63.9 ± 6.9 | | |
| MCL1-1207 | | 44.4 ± 11.7 | | |
| MCL1-1276 | | 38.1 ± 21.3 | | |
| MCL1-1293 | | 58.6 ± 8.5 | | |
| MCL1-1329 | | 49 ± 8.3 | | |
| MCL1-1334 | | 38 ± 7.2 | | |
| MCL1-1335 | | 26.1 ± 5.4 | | |
| MCL1-1340 | | 45.8 ± 2.6 | | |
| MCL1-1357 | | 54.6 ± 10.3 | | |
| MCL1-1385 | | 41.7 ± 8 | | |
| MCL1-1402 | | 32.9 ± 3.8 | | |
| MCL1-1438 | | 95.5 ± 7.1 | | |
| MCL1-1466 | | 34.1 ± 3.6 | | |
| MCL1-1486 | | 60.3 ± 16.4 | | |
| MCL1-1514 | | 69.4 ± 10.1 | | |
| MCL1-1542 | | 33.9 ± 4.8 | | |
| MCL1-1545 | | 31.7 ± 12.3 | | |
| MCL1-1546 | | 27.3 ± 4.1 | | |
| MCL1-1567 | | 26 ± 6.2 | | |
| MCL1-1572 | | 26 ± 4.5 | | |
| MCL1-1593 | | 38.6 ± 7.6 | | |
| MCL1-1604 | | 54.4 ± 4 | | |
| MCL1-1640 | | 43.4 ± 5.3 | | |
| MCL1-1642 | | 42.4 ± 5.7 | | |
| MCL1-1665 | | 42.9 ± 3.3 | | |
| MCL1-1711 | | 34.9 ± 10.2 | | |
| MCL1-1754 | | 41.7 ± 10.2 | | |
| MCL1-1798 | | 43.1 ± 8.1 | | |
| MCL1-1808 | | 30.2 ± 5.5 | | |
| MCL1-1809 | | 43.8 ± 3.4 | | |
| MCL1-1810 | | 40.6 ± 10.7 | | |
| MCL1-1829 | | 36.3 ± 13.8 | | |
| MCL1-1833 | | 25.4 ± 4.2 | | |
| MCL1-1866 | | 40 ± 18.7 | | |
| MCL1-1893 | | 94.5 ± 2.9 | | |
| MCL1-1936 | | 45.5 ± 10.8 | | |
| MCL1-1948 | | 30.8 ± 6.9 | | |
| MCL1-1982 | | 45.5 ± 5.5 | | |
| MCL1-2057 | | 35.6 ± 5.1 | | |
| MCL1-2107 | | 29.6 ± 8.4 | | |
| MCL1-2137 | | 59 ± 0.7 | | |
| MCL1-2174 | | 44.1 ± 5.4 | | |
| MCL1-2193 | | 48.2 ± 7.1 | | |
| MCL1-2200 | | 30.3 ± 4.7 | | |
| MCL1-2204 | | 34.5 ± 10.5 | | |
| MCL1-2235 | | 30.6 ± 9.9 | | |
| MCL1-2275 | | 34.1 ± 2.6 | | |
| MCL1-2309 | | 54.2 ± 5.8 | | |
| MCL1-2334 | | 65.6 ± 8.5 | | |
| MCL1-2389 | | 71.2 ± 4.1 | | |
| MCL1-2459 | | 36.3 ± 12.9 | | |
| MCL1-2491 | | 39.7 ± 6.9 | | |
| MCL1-2536 | | 140 ± 6.1 | | |
| MCL1-2581 | | 42.7 ± 9.5 | | |
| MCL1-2611 | | 39.4 ± 8.3 | | |
| MCL1-2622 | | 42.4 ± 8.8 | | |

TABLE 11-continued

MCL1 Inhibitory Efficacy of DsiRNAs Assayed at 1 nM in Human Huh7 Cells and Mouse Hepa 1-6 Cells - First Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) | Mouse Hepa 1-6 Cells % Remaining MCL1 mRNA ± % Error (Assays: Mm MCL1 558-675 (FAM) & 975-1131 (MAX)) | Mouse Hepa 1-6 Cells (New Assay) % Remaining MCL1 mRNA ± % Error (Assay: Mm MCL1 2340-2593 (FAM)) |
|---|---|---|---|---|
| MCL1-2643 | | 36 ± 10.2 | | |
| MCL1-2671 | | 41.4 ± 13.9 | | |
| MCL1-2725 | | 31.7 ± 27.1 | | |
| MCL1-2750 | | 44.7 ± 6.2 | | |
| MCL1-2874 | | 75.4 ± 4.8 | | |
| MCL1-2875 | | 65.4 ± 6.1 | | |
| MCL1-2881 | | 58 ± 4.3 | | |
| MCL1-2882 | | 65.1 ± 5.1 | | |
| MCL1-2883 | | 50.6 ± 7.1 | | |
| MCL1-2884 | | 46.2 ± 8.1 | | |
| MCL1-2887 | | 46.3 ± 10 | | |
| MCL1-2890 | | 44.6 ± 12.7 | | |
| MCL1-2945 | | 71 ± 12.2 | | |
| MCL1-2951 | | 57.1 ± 3 | | |
| MCL1-3114 | | 64.7 ± 5 | | |
| MCL1-3123 | | 74.7 ± 2.3 | | |
| MCL1-3126 | | 105.4 ± 3.5 | | |
| MCL1-3186 | | 45.7 ± 6.9 | | |
| MCL1-3207 | | 62.8 ± 12 | | |
| MCL1-3232 | | 49.6 ± 7.1 | | |
| MCL1-3239 | | 69.9 ± 6.1 | | |
| MCL1-3241 | | 79.1 ± 6.4 | | |
| MCL1-3265 | | 63.6 ± 6.5 | | |
| MCL1-3277 | | 53.5 ± 6 | | |
| MCL1-3326 | | 61.2 ± 22.6 | | |
| MCL1-3370 | | 76.4 ± 4.5 | | |
| MCL1-3399 | | 63.7 ± 5.8 | | |
| MCL1-3446 | | 60.3 ± 7 | | |
| MCL1-3492 | | 37.4 ± 8.3 | | |
| MCL1-3498 | | 54.3 ± 11.6 | | |
| MCL1-3508 | | 55.8 ± 7.2 | | |
| MCL1-3511 | | 60 ± 7.9 | | |
| MCL1-3552 | | 56.7 ± 7.4 | | |
| MCL1-3568 | | 44.1 ± 17.5 | | |
| MCL1-3573 | | 69.1 ± 2.6 | | |
| MCL1-3574 | | 54.4 ± 2.9 | | |
| MCL1-3576 | | 72.1 ± 3.4 | | |
| MCL1-3577 | | 54 ± 3 | | |
| MCL1-3578 | | 73.2 ± 10.1 | | |
| MCL1-3579 | | 60.4 ± 2.3 | | |
| MCL1-3580 | | 49.2 ± 6.2 | | |
| MCL1-3690 | | 49.7 ± 3.6 | | |
| MCL1-3720 | | 93.8 ± 3.8 | | |
| MCL1-3758 | | 79.4 ± 5.8 | | |
| MCL1-3759 | | 112.9 ± 12.9 | | |
| MCL1-3844 | | 46.1 ± 7.5 | | |
| MCL1-3879 | | 56.6 ± 5 | | |
| MCL1-3915 | | 45.5 ± 4.3 | | |
| MCL1-3924 | | 50.3 ± 6.1 | | |
| MCL1-3930 | | 52.1 ± 10 | | |
| MCL1-809 | 758 | 71.1 ± 1.8 | 66 ± 5.5 | 98 ± 8.3 |
| MCL1-810 | 759 | 59.8 ± 3.9 | 62.2 ± 6.1 | 74.7 ± 11.9 |
| MCL1-811 | 760 | 66.2 ± 4.5 | 68.7 ± 4.7 | 32.6 ± 15.4 |
| MCL1-812 | 761 | 54.6 ± 12.9 | 59.4 ± 4.2 | 45.8 ± 6.7 |
| MCL1-813 | 762 | 95.3 ± 10 | 74.2 ± 8.6 | 70.4 ± 14.1 |
| MCL1-814 | 763 | 81 ± 5.4 | 67 ± 6.7 | 68.3 ± 6.6 |
| MCL1-815 | 764 | 110.5 ± 15.9 | 85.8 ± 4.3 | 82.4 ± 37.7 |
| MCL1-816 | 765 | 89.4 ± 10.9 | 82.5 ± 7.3 | 69.8 ± N/A |
| MCL1-817 | 766 | 86.2 ± 8.7 | 68.1 ± 7 | 91.4 ± 13.7 |
| MCL1-818 | 767 | 62.7 ± 7.4 | 66.3 ± 11.5 | 75.1 ± 4.6 |
| MCL1-819 | 768 | 75.7 ± 3.4 | 68.1 ± 5.9 | 43.1 ± 7.9 |
| MCL1-820 | 769 | 71.3 ± 7 | 66.9 ± 9 | 45.4 ± 1.8 |
| MCL1-821 | 770 | 80.6 ± 9.6 | 64.1 ± 3.9 | 77.4 ± 9 |
| MCL1-822 | 771 | 79 ± 8.6 | 65.9 ± 11.8 | 64.1 ± 6.2 |
| MCL1-1012 | 961 | 57 ± 2.7 | 96.6 ± 14.7 | 43.8 ± 4.1 |
| MCL1-1013 | 962 | 56.4 ± 5.6 | 63 ± 9.1 | 70.9 ± 2.2 |
| MCL1-1076 | 1025 | 80 ± 3.7 | 71.1 ± 7.8 | 72.4 ± 19.8 |
| MCL1-1077 | 1026 | 84 ± 4.5 | 70.8 ± 5.7 | 73.8 ± 29.4 |
| MCL1-1078 | 1027 | 55.4 ± 4.9 | 51.7 ± 10.5 | 37.1 ± 11.3 |
| MCL1-1079 | 1028 | 45.1 ± 8.4 | 31 ± 19.3 | 37.6 ± 22 |

TABLE 11-continued

MCL1 Inhibitory Efficacy of DsiRNAs Assayed at 1 nM in Human Huh7 Cells and Mouse Hepa 1-6 Cells - First Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) | Mouse Hepa 1-6 Cells % Remaining MCL1 mRNA ± % Error (Assays: Mm MCL1 558-675 (FAM) & 975-1131 (MAX)) | Mouse Hepa 1-6 Cells (New Assay) % Remaining MCL1 mRNA ± % Error (Assay: Mm MCL1 2340-2593 (FAM)) |
|---|---|---|---|---|
| MCL1-1080 | 1029 | 62.2 ± 7.8 | 39.6 ± 9.8 | 44.3 ± 9.1 |
| MCL1-1081 | 1030 | 109.6 ± 4.4 | 80 ± 7.7 | 73.7 ± 2.5 |
| MCL1-1082 | 1031 | 75.5 ± 6.4 | 85.3 ± 12.4 | 32.8 ± 20.9 |
| MCL1-1083 | 1032 | 66.1 ± 3.5 | 57.8 ± 10.4 | 66.8 ± 8.5 |
| MCL1-1084 | 1033 | 57.2 ± 12.4 | 57.2 ± 11.4 | 90.8 ± 6.2 |
| MCL1-1085 | 1034 | 46.5 ± 6.5 | 49 ± 5.6 | 60.6 ± 10.9 |
| MCL1-1086 | 1035 | 33.9 ± 3.3 | 59.5 ± 8.2 | 65.5 ± 17.4 |
| MCL1-1087 | 1036 | 47.9 ± 4.6 | 51.3 ± 14.3 | 59.2 ± 3.7 |
| MCL1-1088 | 1037 | 79.9 ± 13 | 58.7 ± 12 | 80.6 ± 8.5 |
| MCL1-1089 | 1038 | 31.8 ± 6.4 | 62 ± 15.6 | 65.5 ± 14.6 |
| MCL1-1090 | 1039 | 19.7 ± 18.3 | 46 ± 10.8 | 61.1 ± 30.7 |
| MCL1-1091 | 1040 | 19.7 ± 3.4 | 35.2 ± 9.5 | 38.4 ± 34.8 |
| MCL1-1092 | 1041 | 57.3 ± 8.2 | 78.9 ± 6.4 | 111.8 ± 16.2 |
| MCL1-1093 | 1042 | 58.4 ± 9.4 | 75.7 ± 11.9 | 70 ± 25.1 |
| MCL1-1094 | 1043 | 38.3 ± 2.6 | 75.1 ± 7.6 | 50.1 ± 16.7 |
| MCL1-1095 | 1044 | 25.3 ± 5.1 | 39.6 ± 4.9 | 56.1 ± 10.9 |
| MCL1-1188 | 1137 | 117.8 ± 5.3 | 77.8 ± 11.8 | 53.5 ± 13.3 |
| MCL1-1189 | 1138 | 71.9 ± 5.4 | 73.4 ± 8.1 | 62.8 ± 15.2 |
| MCL1-1190 | 1139 | 47.8 ± 4.2 | 55 ± 10.4 | 76.8 ± 13.7 |
| MCL1-1191 | 1140 | 59.6 ± 8.8 | 40 ± 4.6 | 68.5 ± 8.2 |
| MCL1-1192 | 1141 | 76.2 ± 10.9 | 42.7 ± 7.1 | 72.7 ± 18 |
| MCL1-1193 | 1142 | 63.5 ± 8.7 | 57.9 ± 5.1 | 86.7 ± 14.2 |
| MCL1-1348 | 1317 | 34.7 ± 7.2 | 33.7 ± 8.5 | 32.7 ± 7.8 |
| MCL1-1349 | 1318 | 30.4 ± 11.4 | 19.5 ± 6.7 | 21.4 ± 14 |
| MCL1-1350 | 1319 | 30.3 ± 15.2 | 19.8 ± 7.6 | 11.9 ± 14.4 |
| MCL1-1351 | 1320 | 32.7 ± 3.8 | 26.3 ± 4.1 | 31.1 ± 13.1 |
| MCL1-1352 | 1321 | 38.5 ± 8.2 | 31.7 ± 5.2 | 49.9 ± 6 |
| MCL1-1353 | 1322 | 46.7 ± 8.2 | 35.5 ± 8.6 | 46.1 ± 6.2 |
| MCL1-1354 | 1323 | 43.3 ± 29.1 | 18.4 ± 17.3 | 15.4 ± 22.7 |
| MCL1-1355 | 1324 | 36.3 ± 9.3 | 20.9 ± 14.9 | 15.6 ± 7.9 |
| MCL1-1356 | 1325 | 61.3 ± 7.5 | 38.2 ± 7 | 16.3 ± 8.9 |
| MCL1-1912 | 1880 | 39 ± 8 | 45.5 ± 10.8 | 27.3 ± 3.8 |
| MCL1-1913 | 1881 | 33.5 ± 2.3 | 76.1 ± 21.9 | 27.2 ± 16.3 |
| MCL1-1914 | 1882 | 19.3 ± 6.2 | 49.3 ± 9.6 | 24.4 ± 15 |
| MCL1-1915 | 1883 | 17.6 ± 5 | 38.8 ± 11.2 | 28.4 ± 3.6 |
| MCL1-1916 | 1884 | 15.6 ± 4.2 | 36.8 ± 4.9 | 19.2 ± 11.3 |
| MCL1-3211 | 2781 | 38.9 ± 17.2 | 82.1 ± 8.2 | 12.6 ± 16.4 |
| MCL1-3212 | 2782 | 52.4 ± 13.9 | 64 ± 14.4 | 28.5 ± 11.2 |
| MCL1-3213 | 2783 | 40.1 ± 10.2 | 86.3 ± 6.3 | 9.4 ± 13.8 |
| MCL1-3214 | 2784 | 52.2 ± 12.4 | 81.5 ± 7.3 | 28.1 ± 27 |
| MCL1-3215 | 2785 | 45.9 ± 11.9 | 84.6 ± 36.9 | 19.7 ± 21 |
| MCL1-m69 | | | 125.2 ± 7 | 106.5 ± 8.1 |
| MCL1-m172 | | | 47.9 ± 10 | 52.1 ± 9.6 |
| MCL1-m469 | | | 75.2 ± 13.7 | 78.7 ± 8 |
| MCL1-m606 | | | 389.7 ± 4.2 | 71.8 ± 8.2 |
| MCL1-m607 | | | 208.3 ± 8.1 | 76.9 ± 6.5 |
| MCL1-m608 | | | 115.3 ± 10.1 | 69.6 ± 2.5 |
| MCL1-m610 | | | 88.6 ± 5.3 | 70.8 ± 10.3 |
| MCL1-m891 | | | 27.9 ± 13.2 | 28.9 ± 2.6 |
| MCL1-m924 | | | 25 ± 6.5 | 21.9 ± 19.7 |
| MCL1-m925 | | | 32.8 ± 4.6 | 32.1 ± 5.8 |
| MCL1-m926 | | | 32.9 ± 4.6 | 31.7 ± 2.8 |
| MCL1-m939 | | | 46.4 ± 18.3 | 39.1 ± 14.6 |
| MCL1-m966 | | | 20.8 ± 11.4 | 13.8 ± 24.7 |
| MCL1-m973 | | | 55.4 ± 17.7 | 51.3 ± 4.9 |
| MCL1-m1011 | | | 43 ± 8.2 | 42.8 ± 6 |
| MCL1-m1012 | | | 38.4 ± 3.1 | 39.6 ± N/A |
| MCL1-m1049 | | | 23.6 ± 11.9 | 33.5 ± 12.8 |
| MCL1-m1053 | | | 31.1 ± 15.1 | 37.2 ± 9.6 |
| MCL1-m1060 | | | 86.5 ± 8.6 | 79 ± 4.9 |
| MCL1-m1133 | | | 73 ± 17.5 | 62.9 ± 12.5 |
| MCL1-m1193 | | | 39.7 ± 9.9 | 36.2 ± 19 |
| MCL1-m1222 | | | 27.4 ± 11.5 | 23.4 ± 4.1 |
| MCL1-m1224 | | | 61.7 ± 11.5 | 68 ± 6.5 |
| MCL1-m1227 | | | 47.8 ± N/A | 31.4 ± N/A |
| MCL1-m1269 | | | 28.7 ± 9.2 | 39.5 ± 5.9 |
| MCL1-m1355 | | | 35.7 ± 4 | 21.8 ± 22.6 |
| MCL1-m1356 | | | 51.8 ± 7.2 | 33.3 ± 3.3 |
| MCL1-m1357 | | | 48.3 ± 11.8 | 28.2 ± 3.9 |
| MCL1-m1367 | | | 39.1 ± 4 | 33.4 ± 7.2 |

TABLE 11-continued

MCL1 Inhibitory Efficacy of DsiRNAs Assayed at 1 nM in Human Huh7 Cells and Mouse Hepa 1-6 Cells - First Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) | Mouse Hepa 1-6 Cells % Remaining MCL1 mRNA ± % Error (Assays: Mm MCL1 558-675 (FAM) & 975-1131 (MAX)) | Mouse Hepa 1-6 Cells (New Assay) % Remaining MCL1 mRNA ± % Error (Assay: Mm MCL1 2340-2593 (FAM)) |
|---|---|---|---|---|
| MCL1-m1388 | | | 78.5 ± 5.4 | 72.2 ± 8.7 |
| MCL1-m1389 | | | 86.3 ± 11.2 | 44.6 ± 21.4 |
| MCL1-m1395 | | | 80.4 ± 6.1 | 62.5 ± 5.4 |
| MCL1-m1401 | | | 84.4 ± 7.2 | 19.8 ± 5.2 |
| MCL1-m1409 | | | 54.5 ± 11.5 | 41.9 ± 10.2 |
| MCL1-m1410 | | | 36.8 ± 5.2 | 25.6 ± 9.1 |
| MCL1-m1416 | | | 60.4 ± 3 | 42 ± 1 |
| MCL1-m1420 | | | 49 ± 7 | 27.4 ± 7.3 |
| MCL1-m1447 | | | 43.3 ± 5.5 | 24 ± 13 |
| MCL1-m1491 | | | 40.3 ± 4.1 | 40.2 ± 13.1 |
| MCL1-m1492 | | | 39.8 ± 6.8 | 20.7 ± 37.6 |
| MCL1-m1500 | | | 49.3 ± 6.6 | 35.2 ± 3 |
| MCL1-m1556 | | | 48.1 ± 19.8 | 31.8 ± 17.5 |
| MCL1-m1601 | | | 71.9 ± 3.6 | 63.6 ± 7.4 |
| MCL1-m1602 | | | 89.5 ± 4.8 | 54.4 ± 19.6 |
| MCL1-m1609 | | | 47 ± 7.3 | 35.7 ± 9.3 |
| MCL1-m1610 | | | 71 ± 4.5 | 63.6 ± 10.2 |
| MCL1-m1611 | | | 77.8 ± 5.7 | 65 ± 9.7 |
| MCL1-m1612 | | | 65.4 ± 4.4 | 45.2 ± 6.4 |
| MCL1-m1645 | | | 79.5 ± 2.5 | 46.6 ± 10.6 |
| MCL1-m1681 | | | 67.5 ± 9 | 49.2 ± 4.5 |
| MCL1-m1682 | | | 59.2 ± 4.8 | 72.7 ± 12.5 |
| MCL1-m1686 | | | 52.1 ± 6.9 | 42.1 ± 19.7 |
| MCL1-m1716 | | | 63.3 ± 8.8 | 48.6 ± 3.1 |
| MCL1-m1747 | | | 68.4 ± 14.5 | 38.5 ± 8.9 |
| MCL1-m1778 | | | 40.7 ± 9.8 | 28.3 ± 2 |
| MCL1-m1902 | | | 49.9 ± 11.9 | 29.9 ± 13.8 |
| MCL1-m1957 | | | 47.4 ± 8.2 | 26.8 ± 2.9 |
| MCL1-m2003 | | | 46.8 ± 3.1 | 35.9 ± 3.7 |
| MCL1-m2038 | | | 49.5 ± 3.5 | 26.1 ± 1.2 |
| MCL1-m2063 | | | 50.9 ± 9.6 | 40.3 ± 11.9 |
| MCL1-m2110 | | | 37.6 ± 6.3 | 36.4 ± 4.3 |
| MCL1-m2115 | | | 38.3 ± 11.4 | 40.8 ± 2.6 |
| MCL1-m2162 | | | 55.9 ± 17.9 | 53.5 ± 7.9 |
| MCL1-m2193 | | | 107.6 ± 7.3 | 35.6 ± 12.1 |
| MCL1-m2262 | | | 86.7 ± 0 | 20.3 ± N/A |
| MCL1-m2309 | | | 76 ± 15.1 | 48.1 ± 6.2 |
| MCL1-m2366 | | | 93.3 ± 7.3 | 35.7 ± 14.1 |
| MCL1-m2375 | | | 85.7 ± 5.1 | 44.8 ± 3.2 |
| MCL1-m2415 | | | 74.2 ± 8 | 35.5 ± 9.3 |
| MCL1-m2482 | | | 80.3 ± 5.7 | 43.5 ± 17.8 |
| MCL1-m2500 | | | 91.3 ± 8.5 | 51.5 ± 3.5 |
| MCL1-m2506 | | | 82.3 ± 8.6 | 25.1 ± 37.5 |
| MCL1-m2509 | | | 65.7 ± 11.2 | 13.5 ± 11.6 |
| MCL1-m2510 | | | 83.4 ± 6.7 | 52.3 ± 7.4 |
| MCL1-m2547 | | | 66.8 ± 6.3 | 42.3 ± 6.5 |
| MCL1-m2584 | | | 80.5 ± 5.6 | 39.7 ± 1.6 |
| MCL1-m2651 | | | 76 ± 5.4 | 20.8 ± 9.5 |
| MCL1-m2678 | | | 91.6 ± 8.1 | 44.3 ± 15.8 |
| MCL1-m2706 | | | 67 ± 4.4 | 42 ± 11.4 |
| MCL1-m2758 | | | 79.7 ± 12.8 | 38 ± 15.2 |
| MCL1-m2803 | | | 95.4 ± 3 | 35.2 ± 4.6 |
| MCL1-m2843 | | | 80.7 ± 10.2 | 25.3 ± 3.1 |
| MCL1-m2844 | | | 79.8 ± 4 | 29 ± 7.6 |
| MCL1-m2845 | | | 123.7 ± 10.7 | 26 ± 6.5 |
| MCL1-m2846 | | | 92.6 ± 7.7 | 23.7 ± 7.4 |
| MCL1-m2847 | | | 89.5 ± 10.1 | 34.1 ± 2.8 |
| MCL1-m2848 | | | 67.4 ± 6 | 23 ± 3.7 |
| MCL1-m2849 | | | 74 ± 9.8 | 27.3 ± 6.7 |
| MCL1-m2850 | | | 102.4 ± 5.2 | 31.2 ± 3.6 |
| MCL1-m2859 | | | 85.5 ± 15.5 | 37.8 ± 3.8 |
| MCL1-m2894 | | | 111.2 ± 9.2 | 24.3 ± 10.2 |
| MCL1-m2929 | | | 70.7 ± 5.2 | 31.9 ± 13.2 |
| MCL1-m2975 | | | 74.5 ± 6.4 | 14.6 ± 11.4 |
| MCL1-m2976 | | | 80.2 ± 10.1 | 29.5 ± 13.1 |
| MCL1-m3055 | | | 194 ± 9 | 65.2 ± 10 |
| MCL1-m3068 | | | 87.4 ± 2.7 | 43 ± 3.5 |
| MCL1-m3069 | | | 119.2 ± 4.2 | 42.3 ± 7.7 |
| MCL1-m3070 | | | 92.5 ± 5.7 | 60.7 ± 8.4 |
| MCL1-m3077 | | | 78 ± 5.1 | 35.6 ± 5.7 |

TABLE 11-continued

MCL1 Inhibitory Efficacy of DsiRNAs Assayed at 1 nM in Human Huh7 Cells and Mouse Hepa 1-6 Cells - First Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) | Mouse Hepa 1-6 Cells % Remaining MCL1 mRNA ± % Error (Assays: Mm MCL1 558-675 (FAM) & 975-1131 (MAX)) | Mouse Hepa 1-6 Cells (New Assay) % Remaining MCL1 mRNA ± % Error (Assay: Mm MCL1 2340-2593 (FAM)) |
|---|---|---|---|---|
| MCL1-m3081 | | | 70.7 ± 8.6 | 28.4 ± 15 |
| MCL1-m3104 | | | 82.5 ± 14.8 | 20.1 ± 18.3 |
| MCL1-m3107 | | | 118.2 ± 31.4 | 16.7 ± N/A |
| MCL1-m3145 | | | 84 ± 9 | 43 ± 4.5 |
| MCL1-m3189 | | | 101.7 ± 5.3 | 67.7 ± 7.7 |
| MCL1-m3214 | | | 104.5 ± 6.2 | 34.5 ± 6.9 |
| MCL1-m3219 | | | 83.7 ± 8.6 | 60 ± 8.7 |
| MCL1-m3237 | | | 80.3 ± 13.3 | 22.4 ± 46.7 |
| MCL1-m3238 | | | 88.2 ± 7.2 | 41.5 ± 4.9 |
| MCL1-m3265 | | | 83.1 ± 5.5 | 36.2 ± 2.2 |
| MCL1-m3294 | | | 84.9 ± 9.6 | 45.8 ± 11.7 |
| MCL1-m3340 | | | 89.9 ± 9.5 | 30.4 ± 16.7 |
| MCL1-m3390 | | | 96.5 ± 4.8 | 46 ± 2.8 |
| MCL1-m3407 | | | 74.9 ± 11.4 | 44.6 ± 6.1 |
| MCL1-m3416 | | | 89.7 ± 9.9 | 17.2 ± N/A |
| MCL1-m3430 | | | 92.3 ± 4.8 | 31.1 ± 13 |

As shown in above Table 11, only fourteen of 200 initially assayed asymmetric DsiRNAs examined in human Huh7 cells showed greater than 70% reduction of human MCL1 levels in Huh7 cells at 1 nM. Of these fourteen DsiRNAs, five exhibited 80% or greater reduction of human MCL1 levels in Huh7 cells at 1 nM. Meanwhile, a number of asymmetric DsiRNAs capable of inhibiting mouse MCL1 levels in mouse Hepa 1-6 cells at 1 nM in the environment of a cell were also identified in such assays; however, results varied dramatically between assays. Assay results of Table 11 above were also plotted and are shown in FIGS. 2-1 to 2-4.

Figure 3:
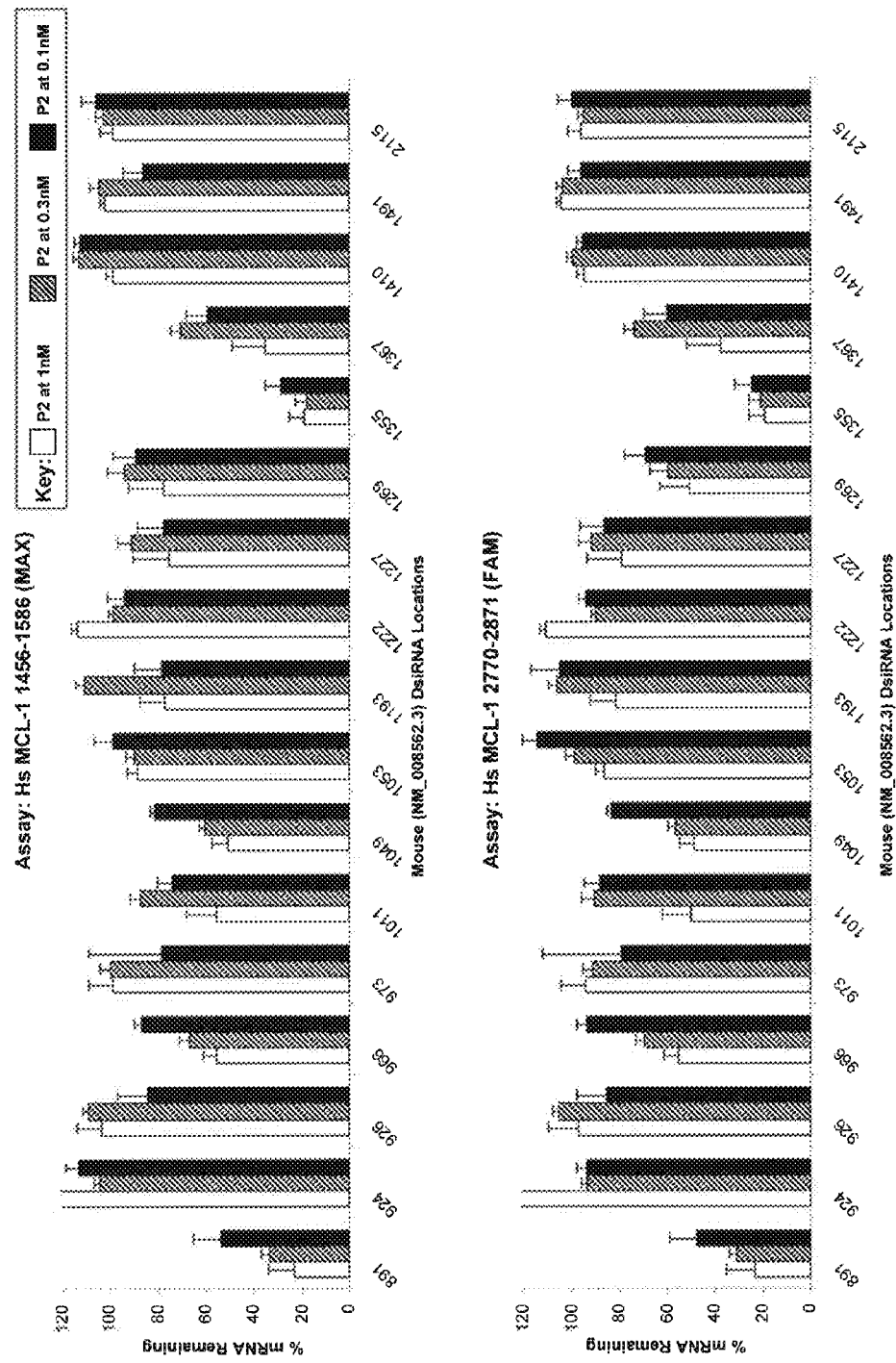
Figures 3, 4:
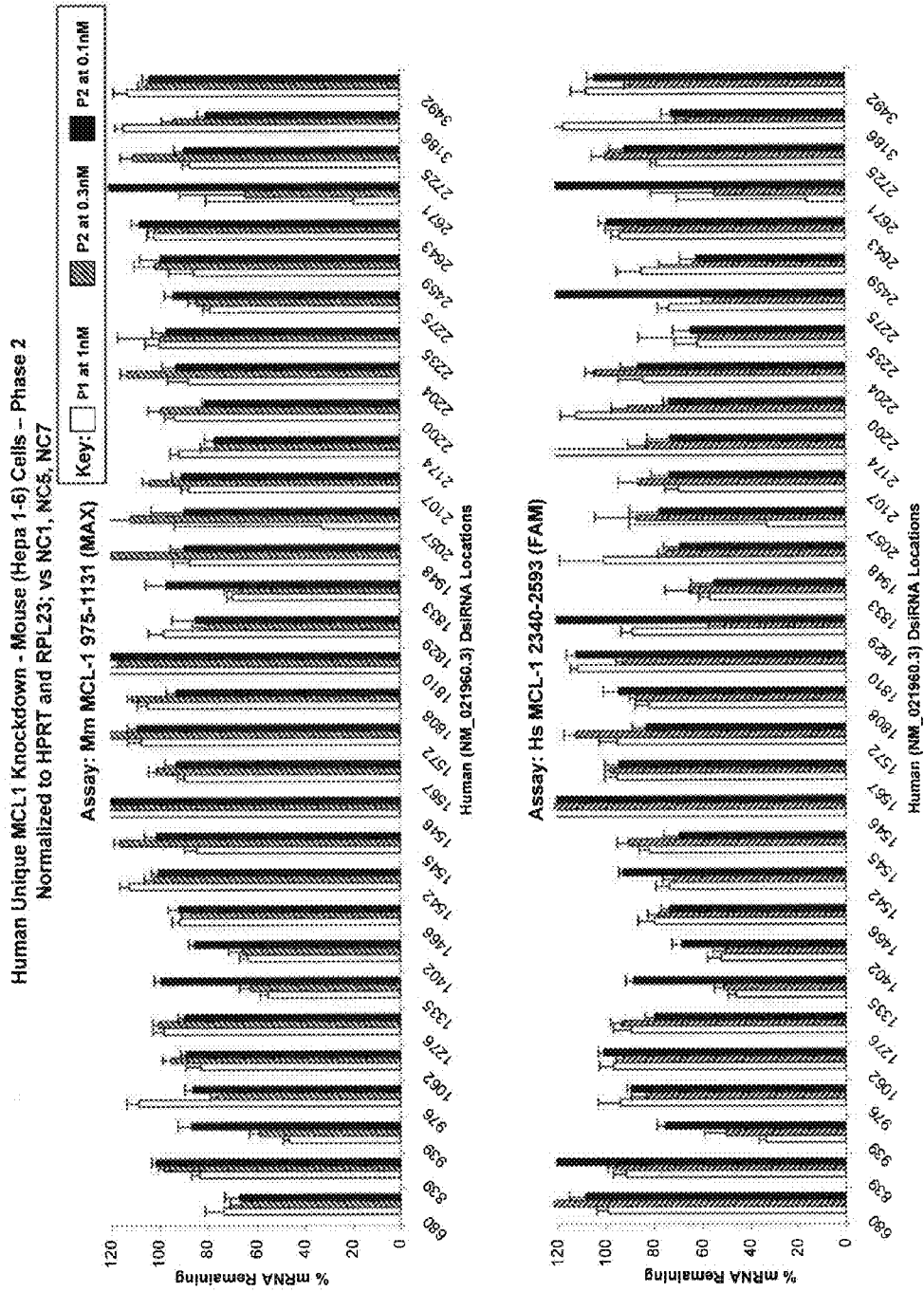
Figures 1, 4:
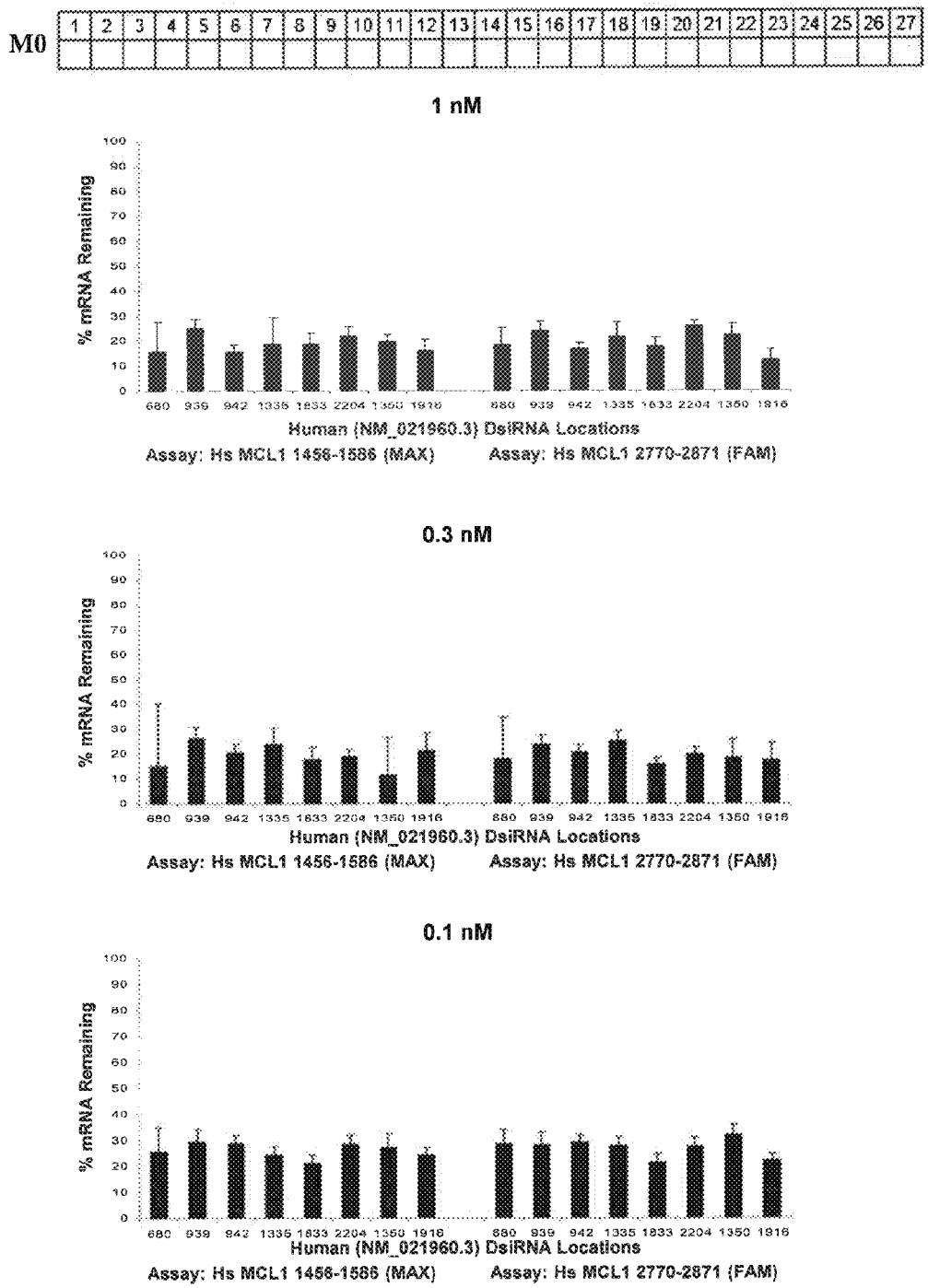
Figures 2, 4:
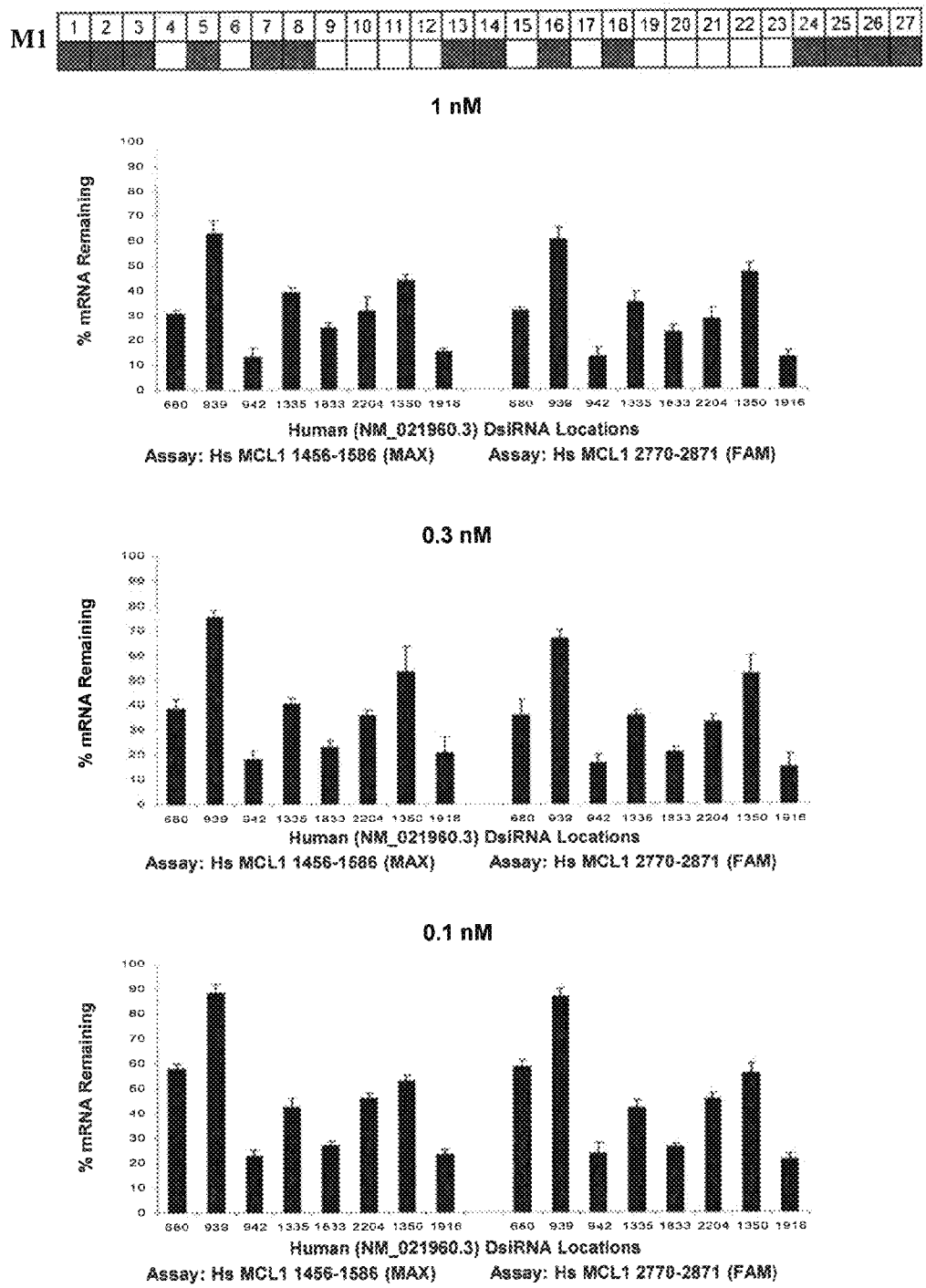
Figures 3, 4:
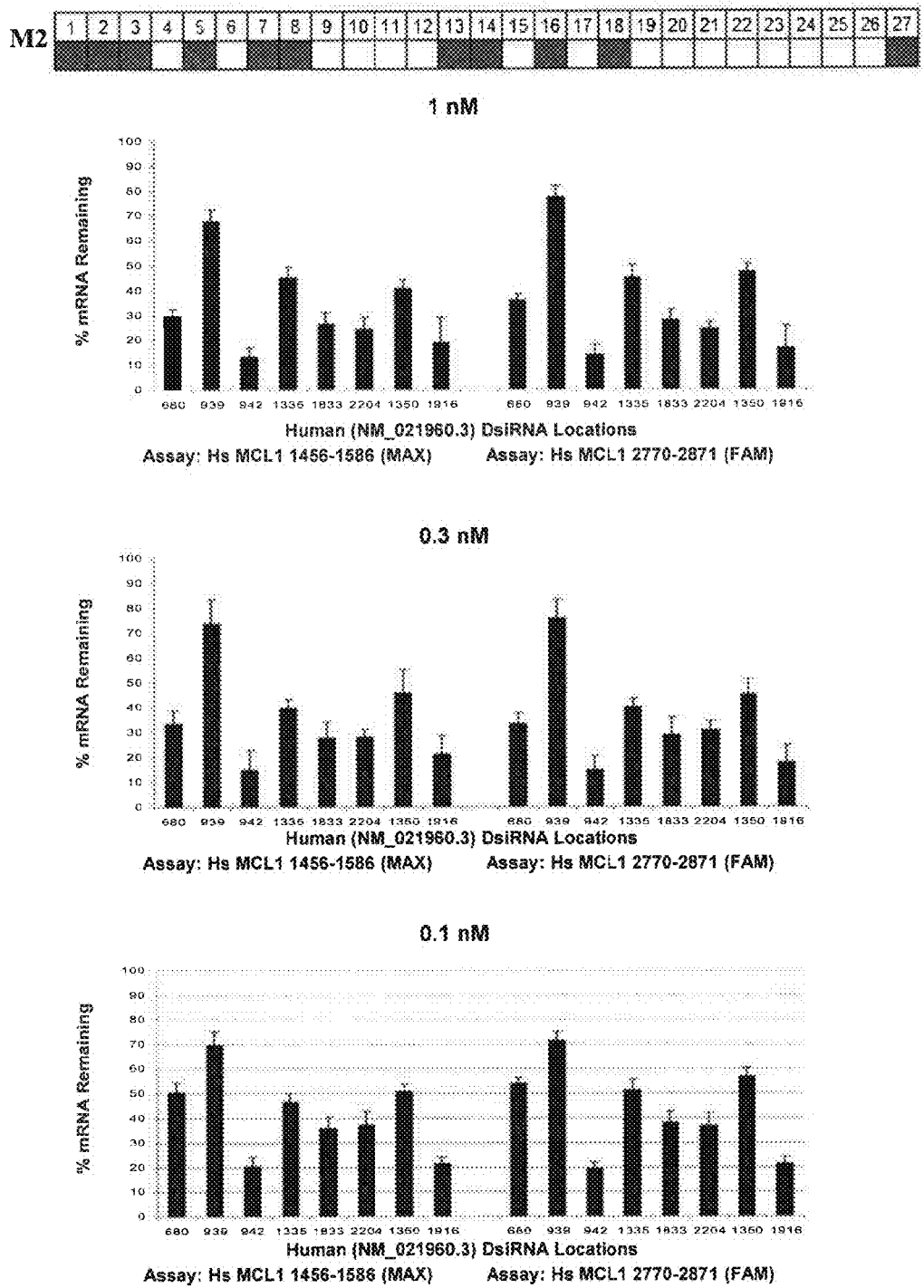
Figure 4:
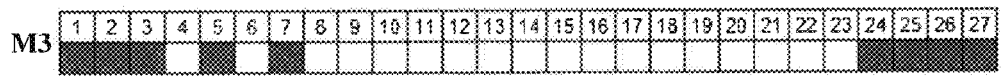
Figure 4:
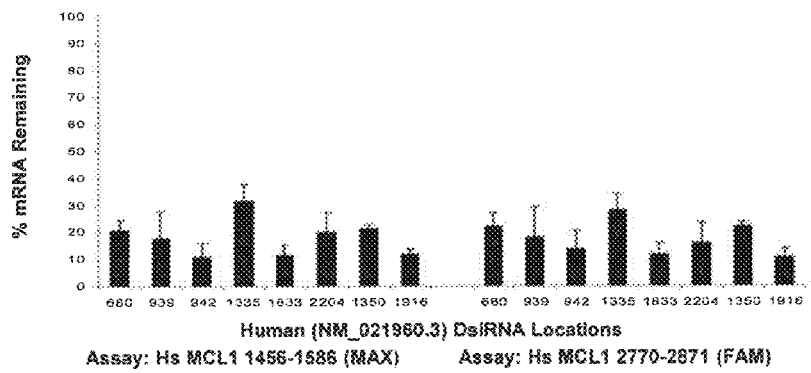
Figure 4:
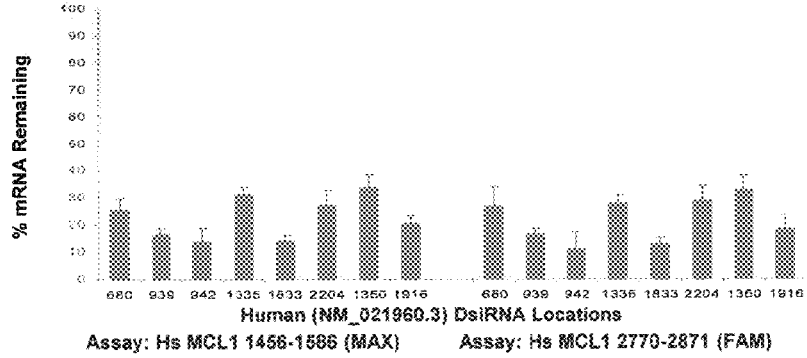
Figure 4:
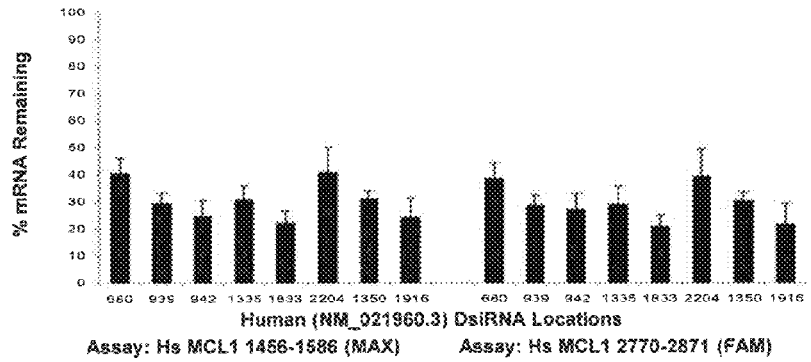
Figures 4, 5:
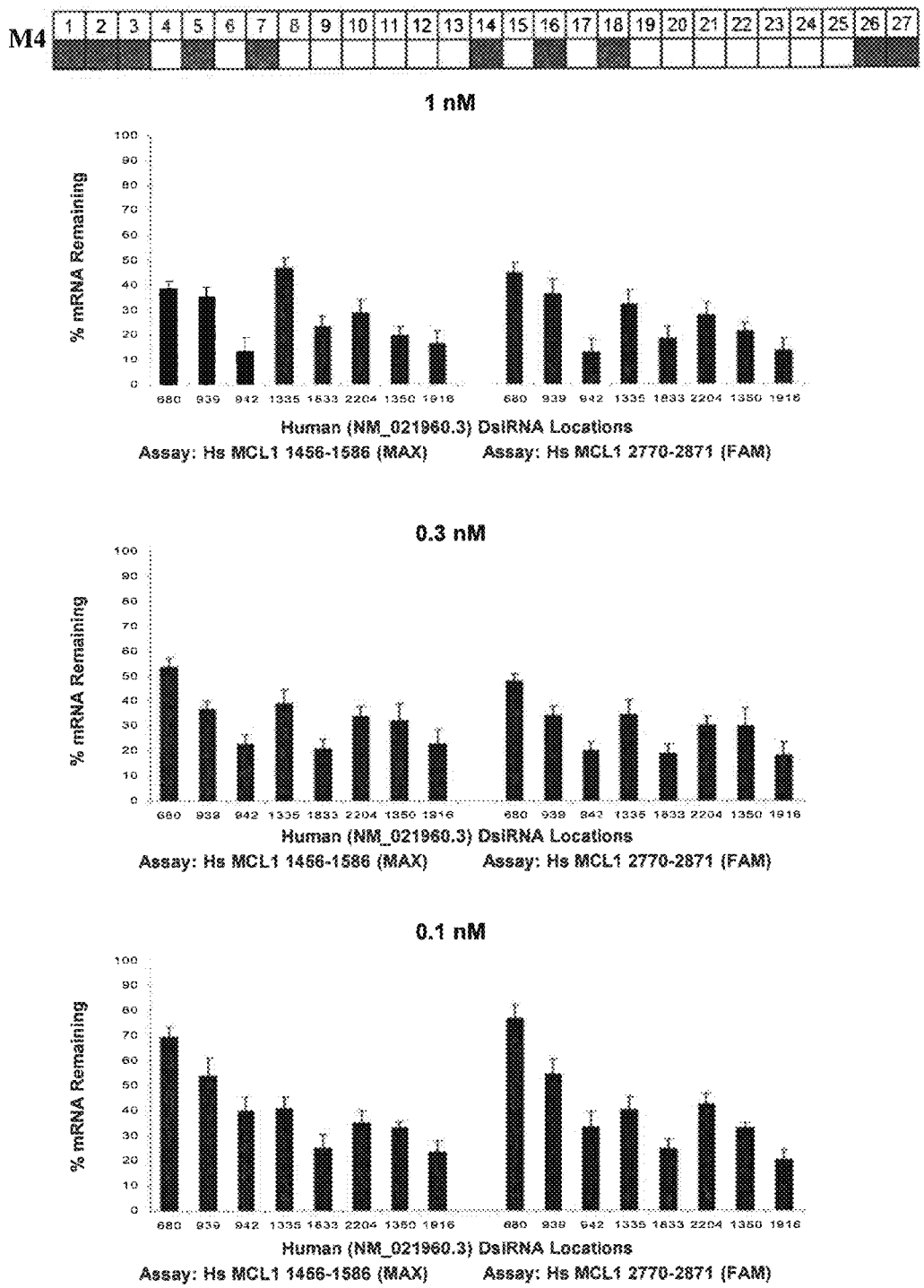

Example 3: DsiRNA Inhibition of MCL1—Secondary Screen 72 asymmetric DsiRNAs (55 targeting Hs MCL1 and 17 uniquely targeting Mm MCL1) of the above experiment were then examined in a secondary assay ("Phase 2"), with results of such assays presented in histogram form in FIGS. 3-1 to 3-6. Specifically, the 72 asymmetric DsiRNAs selected from the 315 tested above were assessed for inhibition of human MCL1 at 1 nM, 0.3 nM and 0.1 nM in the environment of human Huh7 cells (FIGS. 3-1 to 3-3). These 72 asymmetric DsiRNAs were also assessed for inhibition of mouse MCL1 at 1 nM, 0.3 nM and 0.1 nM in the environment of mouse Hepa 1-6 cells (FIGS. 3-4 to 3-6). As shown in FIGS. 3-1 and 3-2, a remarkable number of asymmetric DsiRNAs reproducibly exhibited robust human MCL1 inhibitory efficacies at sub-nanomolar concentrations when assayed in the environment of Huh7 cells. In addition, as shown in FIG. 3-5, a number of these asymmetric DsiRNAs also showed robust mouse MCL1 inhibitory efficacies at sub-nanomolar concentrations when assayed in the environment of mouse Hepa 1-6 cells. (Meanwhile, both human MCL1-specific and mouse MCL1-specific inhibitory asymmetric DsiRNAs were also identified.)

Example 4: Modified Forms of MCL1-Targeting DsiRNAs Reduce MCL1 Levels In Vitro

Eight MCL1-targeting DsiRNAs of the initial screen (MCL1-680, MCL1-939, MCL1-942, MCL1-1335, MCL1-1833, MCL1-2204, MCL1-1350 and MCL1-1916) were prepared with 2'-O-methyl guide strand modification patterns as shown in the schematics of FIGS. 4-1 to 4-16 (including unmodified and above-described guide strand modification patterns "M1" to "M7"). For each of the eight DsiRNA sequences, DsiRNAs possessing each of the eight guide strand modification patterns M0, M1, M2, M3, M4, M5, M6 and M7 were assayed for MCL1 inhibition in human Huh7 cells at 1.0 nM, 0.3 nM and 0.1 nM concentrations in the environment of the Huh7 cells. Results of these experiments are presented as histograms in FIGS. 4-1 to 4-8. These same duplexes were also assayed in mouse Hepa 1-6 cells, with corresponding results shown in FIGS. 4-9 to 4-16. In general, the eight DsiRNA sequences exhibited a trend towards reduced efficacy of MCL1 inhibition as the extent of 2'-O-methyl modification of the guide strand increased. However, for almost all DsiRNA sequences examined, a modification pattern could be identified that allowed the DsiRNA to retain significant MCL1 inhibitory efficacy in vitro. It was also notable that a number of these DsiRNAs (e.g., MCL1-942, MCL1-1833 and MCL1-1916) exhibited robust MCL1 inhibitory efficacy in even the most highly modified states examined. Thus, such highly active modified DsiRNA sequences possess modification patterns believed to be capable of stabilizing such DsiRNAs and/or reducing immunogenicity of such DsiRNAs when therapeutically administered to a subject in vivo.

Example 5: DsiRNA Inhibition of MCL1—Second Primary Screen

An additional primary screen for active DsiRNAs that inhibit MCL1 expression was performed upon 96 duplexes, 95 of which were designed to target human MCL1 alone or both human and mouse MCL1, while the remaining duplex ("MCL1-m1355") was designed to target mouse MCL1 exclusively. Such DsiRNA molecules targeting MCL1 were designed and synthesized as described above and tested in human Huh7 cells or mouse Hepa 1-6 cells for inhibitory efficacy. For transfection, annealed DsiRNAs were mixed with the transfection reagent (Lipofectamine™ RNAiMAX, Invitrogen) and incubated for 20 minutes at room temperature. The Huh7 (human) or Hepa 1-6 (mouse) cells were trypsinized, resuspended in media, and added to wells (100 uL per well) to give a final DsiRNA concentration of 1 nM in a volume of 150 μl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target MCL1 RNA levels following treatment were evaluated by qRT-PCR for the MCL1 target gene, with values normalized to those obtained for controls. Triplicate data was averaged and the % error determined for each treatment Normalized data were graphed and the reduction of target mRNA by active DsiR-NAs in comparison to controls was determined.

MCL1 targeting DsiRNAs examined for MCL1 inhibitory efficacy in this second primary phase of testing are indicated in Table 12 below. In this example, the 96 asymmetric DsiRNAs (tested DsiRNAs possessed a 25/27mer structure) were constructed and tested for MCL1 inhibitory efficacy in human Huh7 cells incubated in the presence of such DsiR-NAs at a concentration of 1 nM. The 96 asymmetric DsiRNAs tested in this second primary screen included DsiRNAs selected from Tables 2 and 4 above, where such DsiRNAs possessed 2'-O-methyl modified residues in a pattern corresponding to the above-referenced "AS-M40" (also referred to as "M40" when only a single modification pattern of the guide strand is referenced) modification pattern. Sequences and structures of these tested asymmetric DsiRNAs are shown in above Tables 2 and 4, where underlined nucleotide residues indicate 2'-O-methyl modified residues, ribonucleotide residues are shown as UPPER CASE, and deoxyribonucleotide residues are shown as lower case).

Assay of the 96 MCL1 targeting DsiRNAs in human Huh7 cells at 1 nM revealed the following MCL1 inhibitory efficacies, presented in Table 12. MCL1 levels were determined using qPCR assays positioned at indicated locations within the MCL1 transcript (paired qPCR assays were performed and are indicated as "Hs MCL1 1456-1586" (MAX) and "Hs MCL1 2770-2871" (FAM)).

TABLE 12

MCL1 Inhibitory Efficacy of DsiRNAs Assayed at 1 nM in Human Huh7 Cells - Second Primary Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) |
|---|---|---|
| MCL1-941 | | 38 ± 9.4 |
| MCL1-943 | | 17.8 ± 6.2 |
| MCL1-965 | | 27.1 ± 8.3 |
| MCL1-968 | | 19.8 ± 6.9 |
| MCL1-1095 | 1044 | 14.9 ± 11.1 |
| MCL1-1308 | | 88.7 ± 11.8 |
| MCL1-1312 | | 23.6 ± 3.6 |
| MCL1-1325 | | 26.5 ± 3.6 |
| MCL1-1338 | | 45.3 ± 7.3 |
| MCL1-1342 | | 38.6 ± 5.9 |
| MCL1-1344 | | 26.8 ± 6.2 |
| MCL1-1349 | 1318 | 24.7 ± 7.3 |
| MCL1-1393 | | 28.7 ± 6.2 |
| MCL1-1397 | | 35.2 ± 5.7 |
| MCL1-1400 | | 30.4 ± 7.3 |
| MCL1-1539 | | 19.3 ± 11 |
| MCL1-1544 | | 18.6 ± 11.1 |
| MCL1-1562 | | 20.8 ± 11.6 |
| MCL1-1568 | | 21.3 ± 6.1 |
| MCL1-1573 | | 25.3 ± 8.3 |
| MCL1-1732 | | 29.9 ± 2.7 |
| MCL1-1734 | | 29.9 ± 6.9 |
| MCL1-1740 | | 35.2 ± 3.7 |
| MCL1-1742 | | 19.4 ± 11 |
| MCL1-1746 | | 31.8 ± 8.6 |
| MCL1-1799 | | 26.5 ± 21.7 |
| MCL1-1822 | | 20.8 ± 6.1 |
| MCL1-1824 | | 24.3 ± 1.5 |
| MCL1-1826 | | 30.2 ± 2.9 |
| MCL1-1831 | | 19.3 ± 10.3 |
| MCL1-1833 | | 12.6 ± 6.3 |
| MCL1-1872 | | 22 ± 5.3 |
| MCL1-1875 | | 21 ± 7.6 |
| MCL1-1916 | 1884 | 11.6 ± 5.9 |
| MCL1-1948 | | 14 ± 3.9 |
| MCL1-1956 | | 40.4 ± 4.3 |
| MCL1-1958 | | 28.4 ± 13.8 |
| MCL1-1969 | | 22.7 ± 4.2 |
| MCL1-2021 | | 38.5 ± 14.9 |
| MCL1-2031 | | 16.1 ± 3 |
| MCL1-2033 | | 24.8 ± 4.6 |
| MCL1-2087 | | 26.4 ± 4.4 |
| MCL1-2091 | | 25.3 ± 8.2 |
| MCL1-2107 | | 22.3 ± 2.5 |
| MCL1-2199 | | 26.1 ± 13.4 |
| MCL1-2212 | | 14.1 ± 11 |
| MCL1-2215 | | 16.8 ± 4.9 |
| MCL1-2217 | | 31.3 ± 7.2 |
| MCL1-2225 | | 31.6 ± 7.8 |
| MCL1-2227 | | 19.3 ± 3.1 |
| MCL1-2230 | | 26 ± 8.1 |
| MCL1-2232 | | 26.8 ± 8.7 |
| MCL1-2236 | | 32.8 ± 8.4 |
| MCL1-2275 | | 29 ± 8.5 |
| MCL1-2304 | | 35.7 ± 3.6 |
| MCL1-2314 | | 27.1 ± 10.8 |
| MCL1-2352 | | 13.9 ± 14.1 |
| MCL1-2473 | | 28.5 ± 5.3 |
| MCL1-2478 | | 24.9 ± 5.3 |
| MCL1-2483 | | 13.8 ± 5 |
| MCL1-2486 | | 18.3 ± 11 |
| MCL1-2501 | | 22.4 ± 9.2 |
| MCL1-2575 | | 34.1 ± 7.2 |
| MCL1-2584 | | 26.6 ± 6.2 |
| MCL1-2591 | | 24.1 ± 2.9 |
| MCL1-2593 | | 25.6 ± 9 |
| MCL1-2596 | | 22.6 ± 4.6 |
| MCL1-2598 | | 23.6 ± 5 |
| MCL1-2602 | | 32.7 ± 8.7 |
| MCL1-2605 | | 25.5 ± 4.8 |
| MCL1-2607 | | 19.5 ± 10.1 |
| MCL1-2609 | | 17.9 ± 16.4 |
| MCL1-2613 | | 40.9 ± 3.7 |
| MCL1-2625 | | 50 ± 3.9 |
| MCL1-2636 | | 42.3 ± 4.8 |
| MCL1-2672 | | 32.7 ± 2.7 |
| MCL1-2679 | | 31.7 ± 6 |
| MCL1-2790 | | 43.9 ± 9.3 |
| MCL1-2799 | | 40.6 ± 5.3 |
| MCL1-2801 | | 42.1 ± 5.1 |
| MCL1-2911 | | 42.4 ± 1.6 |
| MCL1-2992 | | 38.6 ± 6.6 |
| MCL1-3072 | | 59.2 ± 9.5 |
| MCL1-3074 | | 56.7 ± 11.5 |
| MCL1-3252 | | 40.9 ± 11.6 |
| MCL1-3563 | | 38.2 ± 2.8 |

TABLE 12-continued

MCL1 Inhibitory Efficacy of DsiRNAs Assayed at 1 nM
in Human Huh7 Cells - Second Primary Screen

| DsiRNA Name (Human MCL1 Target Location, NM_021960.3) | Mouse MCL1 Target Location | Human Huh7 Cells % Remaining MCL1 mRNA ± % Error (Assays: Hs MCL1 1456-1586 (MAX) & 2770-2871 (FAM)) |
|---|---|---|
| MCL1-3588 | | 42 ± 7.5 |
| MCL1-3789 | | 34.2 ± 2.6 |
| MCL1-3989 | | 42.8 ± 2.6 |
| MCL1-3991 | | 39 ± 7 |
| MCL1-3997 | | 31.7 ± 8.3 |
| MCL1-4000 | | 59.3 ± 4 |
| MCL1-4002 | | 81.9 ± 6.4 |
| MCL1-4008 | | 65.1 ± 11.1 |
| MCL1-m1355 | | 22.6 ± 6.2 |

As shown in above Table 12, 56 of 96 initially assayed asymmetric DsiRNAs examined in human Huh7 cells showed greater than 70% reduction of human MCL1 levels in Huh7 cells at 1 nM. Of these 56 DsiRNAs, 19 exhibited 80% or greater reduction of human MCL1 levels in Huh7 cells at 1 nM. Assay results of Table 12 above were also plotted and are shown in FIG. 5.

Figures 4, 5, 6:
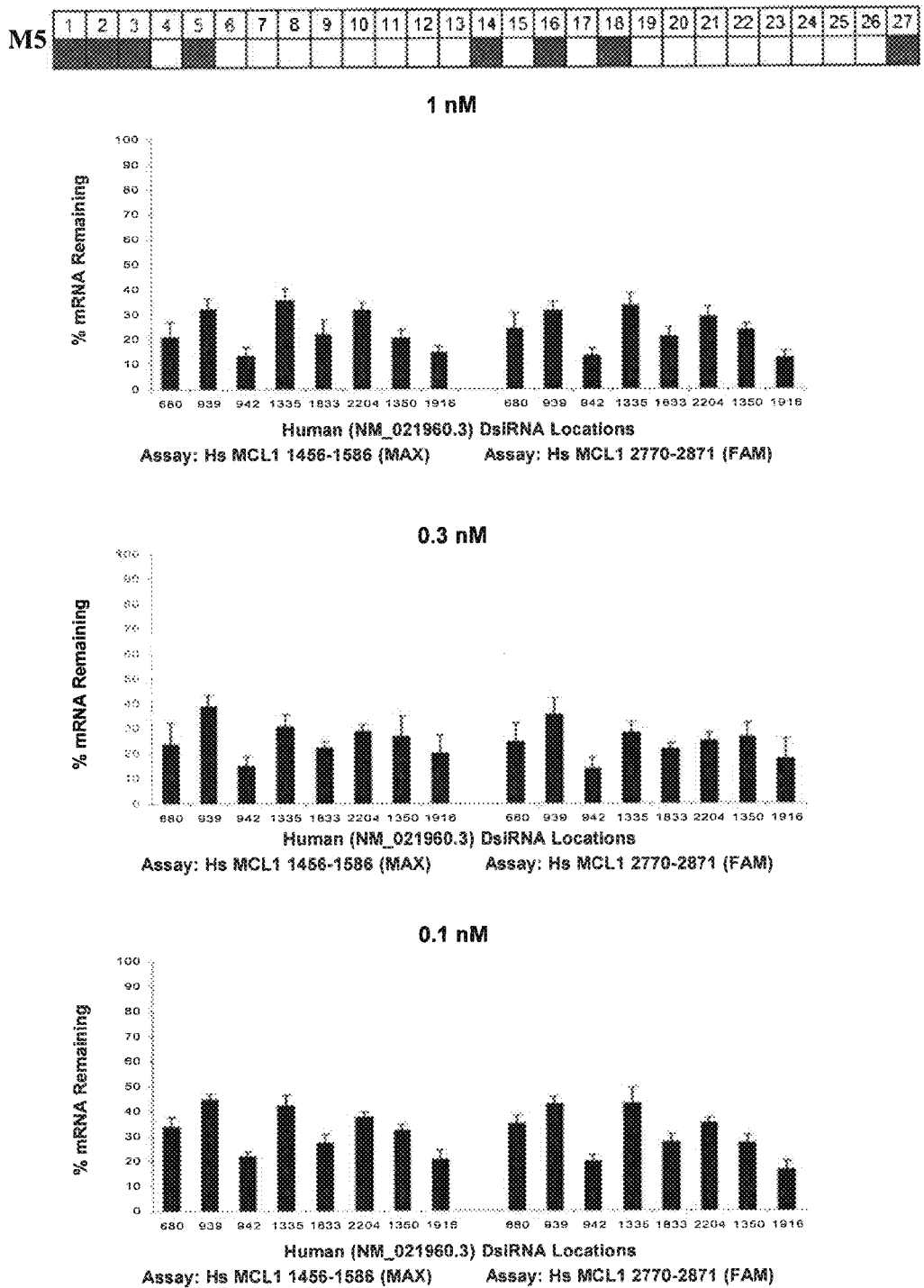
Figures 4, 5, 6, 7:
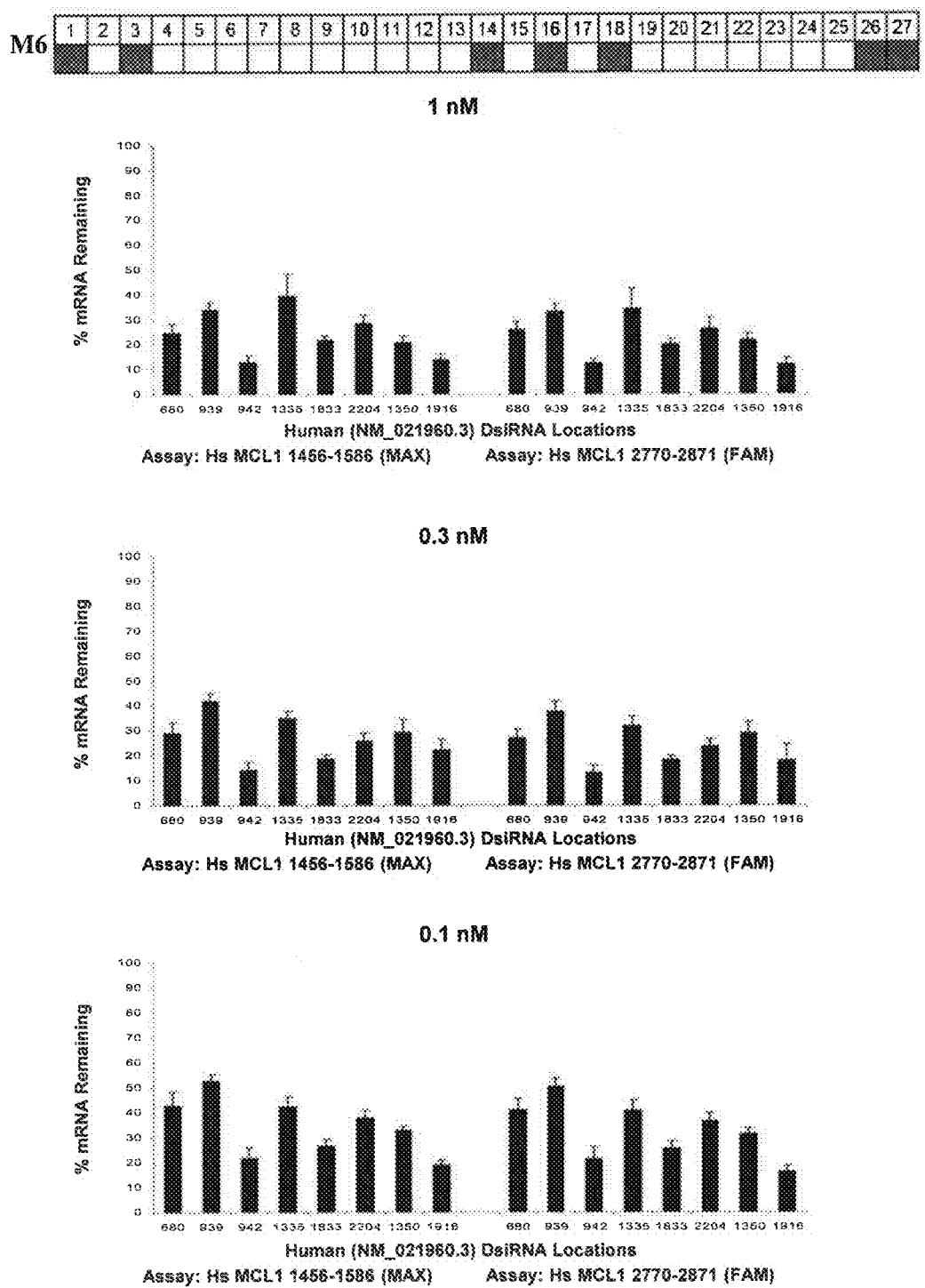

Example 6: DsiRNA Inhibition of MCL1—Second Secondary Screen 24 asymmetric DsiRNAs (23 targeting Hs MCL: MCL1-1095, MCL1-1349, MCL1-1916, MCL1-943, MCL1-968, MCL1-1539, MCL1-1544, MCL1-1562, MCL1-1742, MCL1-1822, MCL1-1831, MCL1-1833, MCL1-1948, MCL1-2031, MCL1-2107, MCL1-2212, MCL1-2215, MCL1-2227, MCL1-2352, MCL1-2483, MCL1-2486, MCL1-2607 and MCL1-2609; one targeting Mm MCL1: MCL1-m1355) of the above experiment were then examined in a secondary assay ("Phase 2"), with results of such assays presented in histogram form in FIG. 6. Specifically, the 24 asymmetric DsiRNAs selected from the 96 tested above were assessed for inhibition of human MCL1 at 1 nM and 0.1 nM in the environment of human Huh7 cells. As shown in FIG. 6, the asymmetric DsiRNAs reproducibly exhibited robust human MCL1 inhibitory efficacies at sub-nanomolar concentrations when assayed in the environment of Huh7 cells.

Example 7: Additional Modified Forms of MCL1-Targeting DsiRNAs Reduce MCL1 Levels In Vitro 24 MCL1-targeting DsiRNAs of the above experiments (MCL1-680, MCL1-939, MCL1-1086, MCL1-1095, MCL1-1350, MCL1-1545, MCL1-1567, MCL1-1742, MCL1-1808, MCL1-1831, MCL1-1833, MCL1-1916, MCL1-1948, MCL1-2107, MCL1-2200, MCL1-2212, MCL1-2215, MCL1-2227, MCL1-2275, MCL1-2352, MCL1-2483, MCL1-2486, MCL1-2607 and MCL1-m1355) were prepared with 2'-O-methyl guide strand modification patterns as represented above and in FIG. 7-1 (including the above-described guide strand modification patterns "M3", "M8", "M12" and "M25"). For each of the 24 DsiRNA sequences, DsiRNAs possessing each of the four guide strand modification patterns M3, M8, M12 and M25 were assayed for MCL1 inhibition in human Huh7 cells at 1.0 nM and 0.1 nM (in duplicate) concentrations in the environment of the Huh7 cells. Results of these experiments are presented as histograms in FIGS. 7-2 to 7-5. These same duplexes were also assayed in mouse Hepa 1-6 cells, with corresponding results shown in FIGS. 7-6 to 7-9. For almost all DsiRNA sequences examined, a modification pattern could be identified that allowed the DsiRNA to retain significant MCL1 inhibitory efficacy in vitro. It was notable that most of these DsiRNAs (e.g., MCL1-680, MCL1-939, MCL1-1545, MCL1-1567, MCL1-1831, MCL1-1833, MCL1-1916, MCL1-1948, MCL1-2107, MCL1-2200, MCL1-2212, MCL1-2227, MCL1-2275, MCL1-2352, MCL1-2483, MCL1-2486, MCL1-2607 and MCL1-m1355) exhibited robust MCL1 inhibitory efficacy across all modified states examined. Such highly active modified DsiRNA sequences possess modification patterns believed to be capable of stabilizing such DsiRNAs and/or reducing immunogenicity of such DsiRNAs when therapeutically administered to a subject in vivo.

Example 8: In Vivo Efficacy of MCL1-Targeting DsiRNAs

Figures 4, 5, 6, 7, 8:
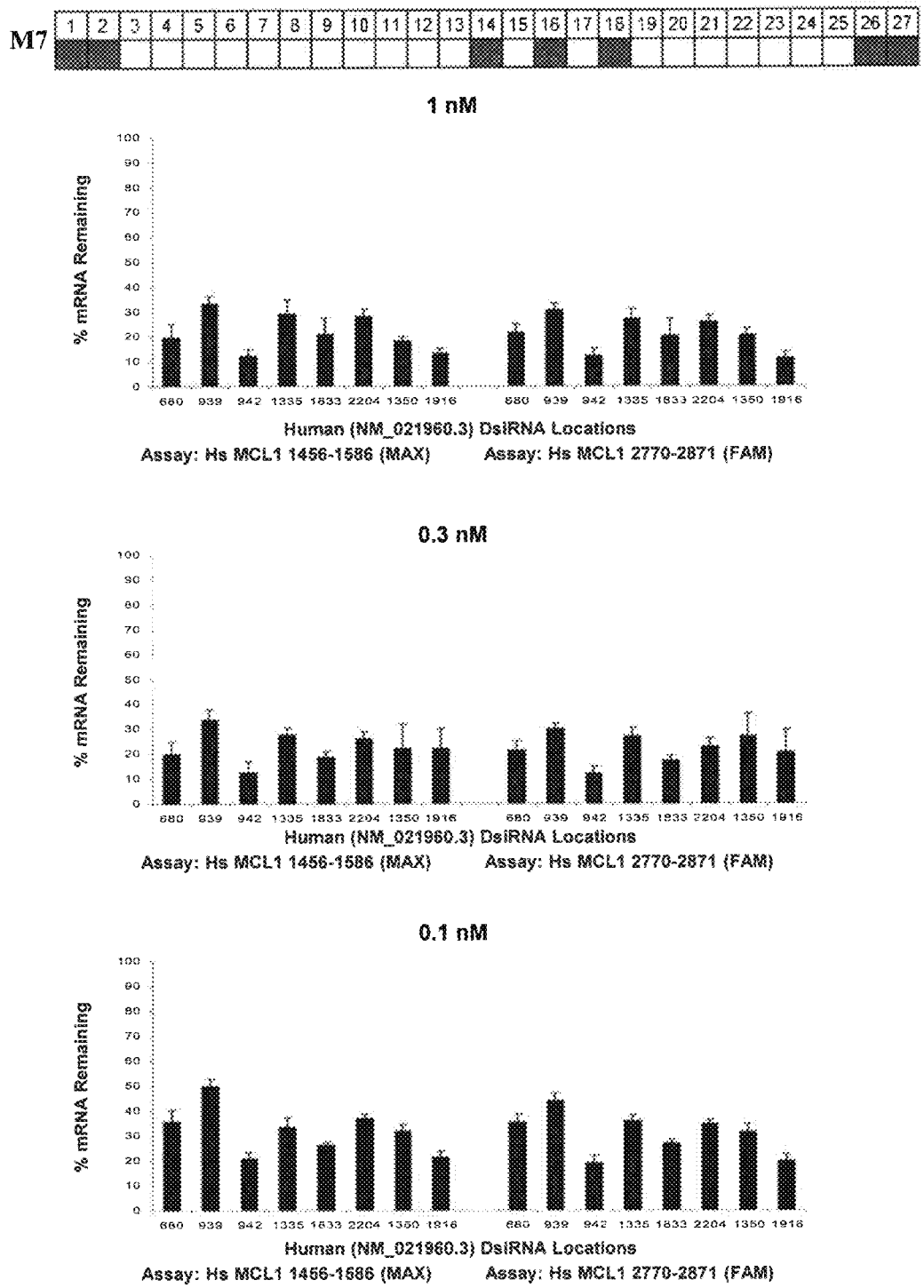
Figures 4, 5, 6, 7, 8, 9, 10:
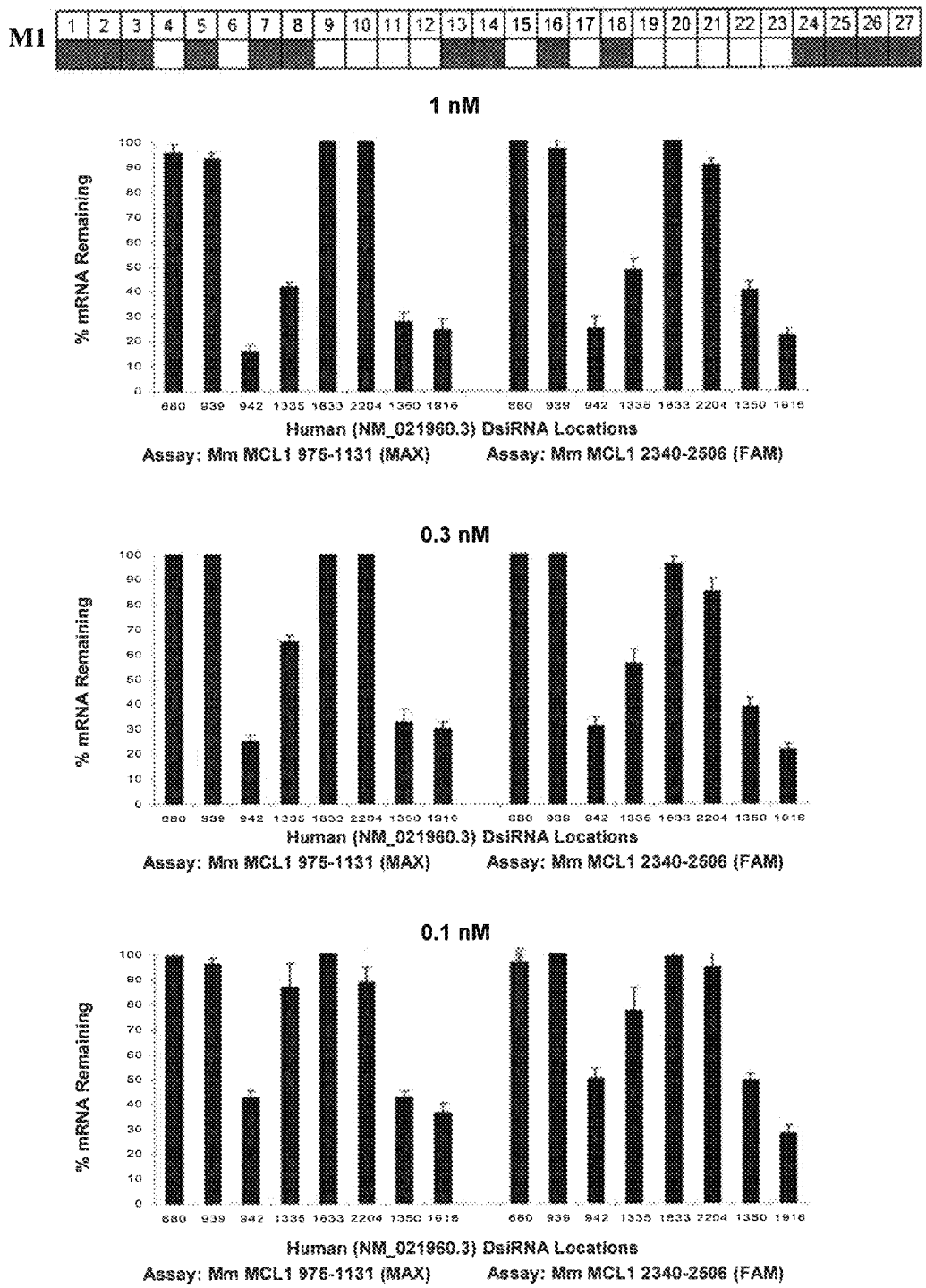
Figures 4, 5, 6, 7, 8, 9, 10, 11, 12, 13:
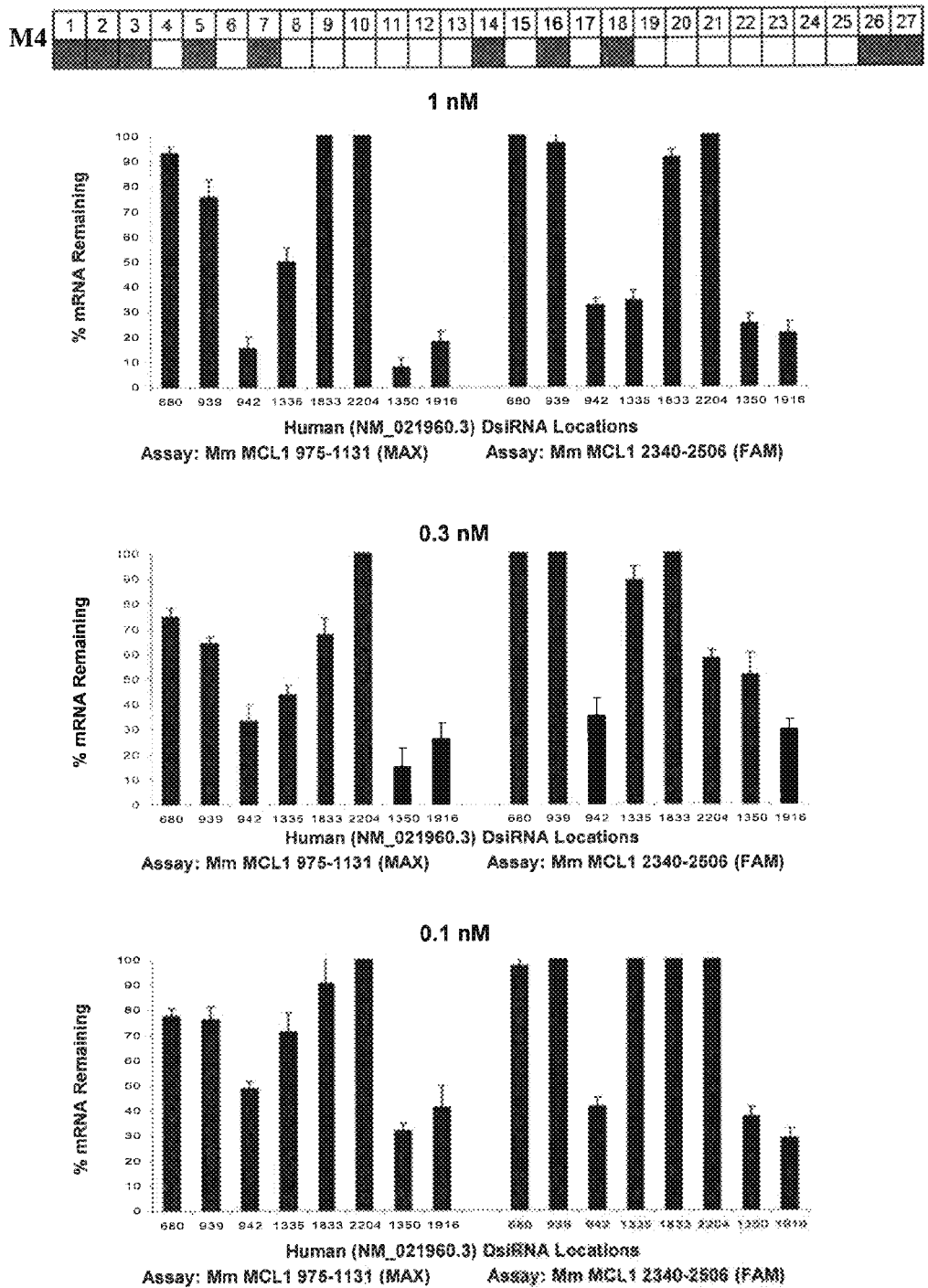
Figures 4, 5, 6, 7, 8, 9, 10, 11, 12, 13, 14:
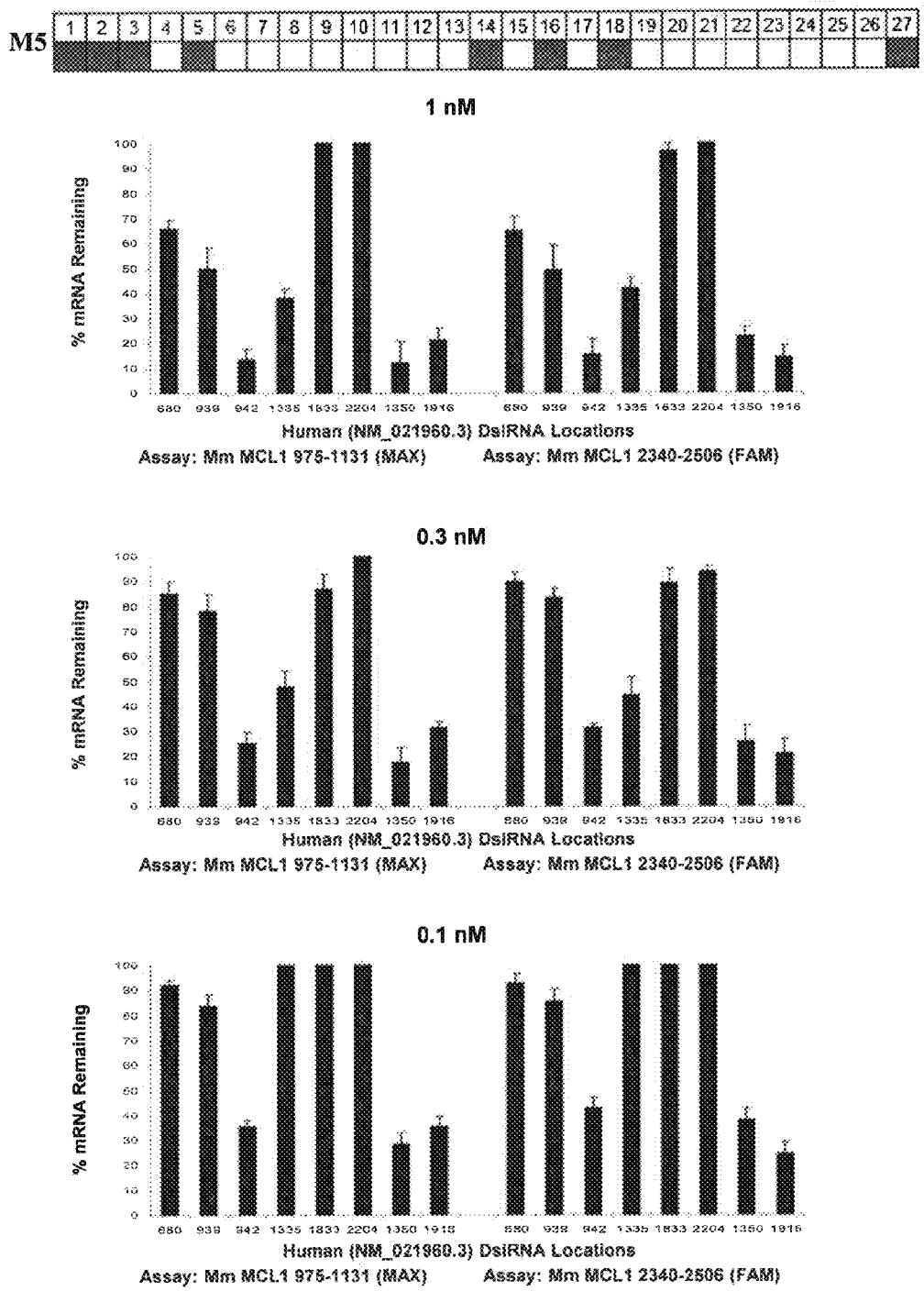
Figures 4, 5, 6, 7, 8, 9, 10, 11, 12, 13, 14, 15:
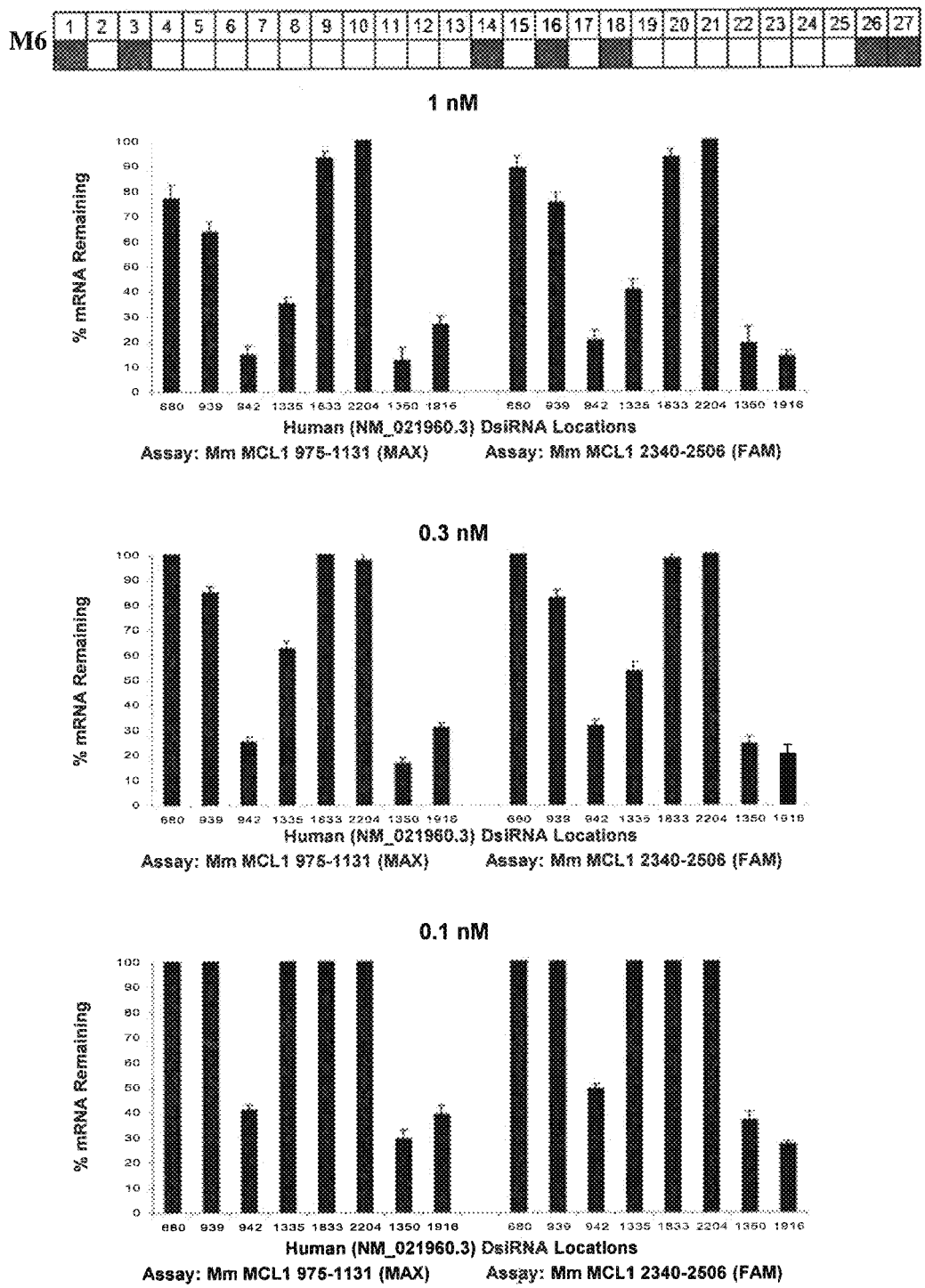
Figures 4, 5, 6, 7, 8, 9, 10, 11, 12, 13, 14, 15, 16:
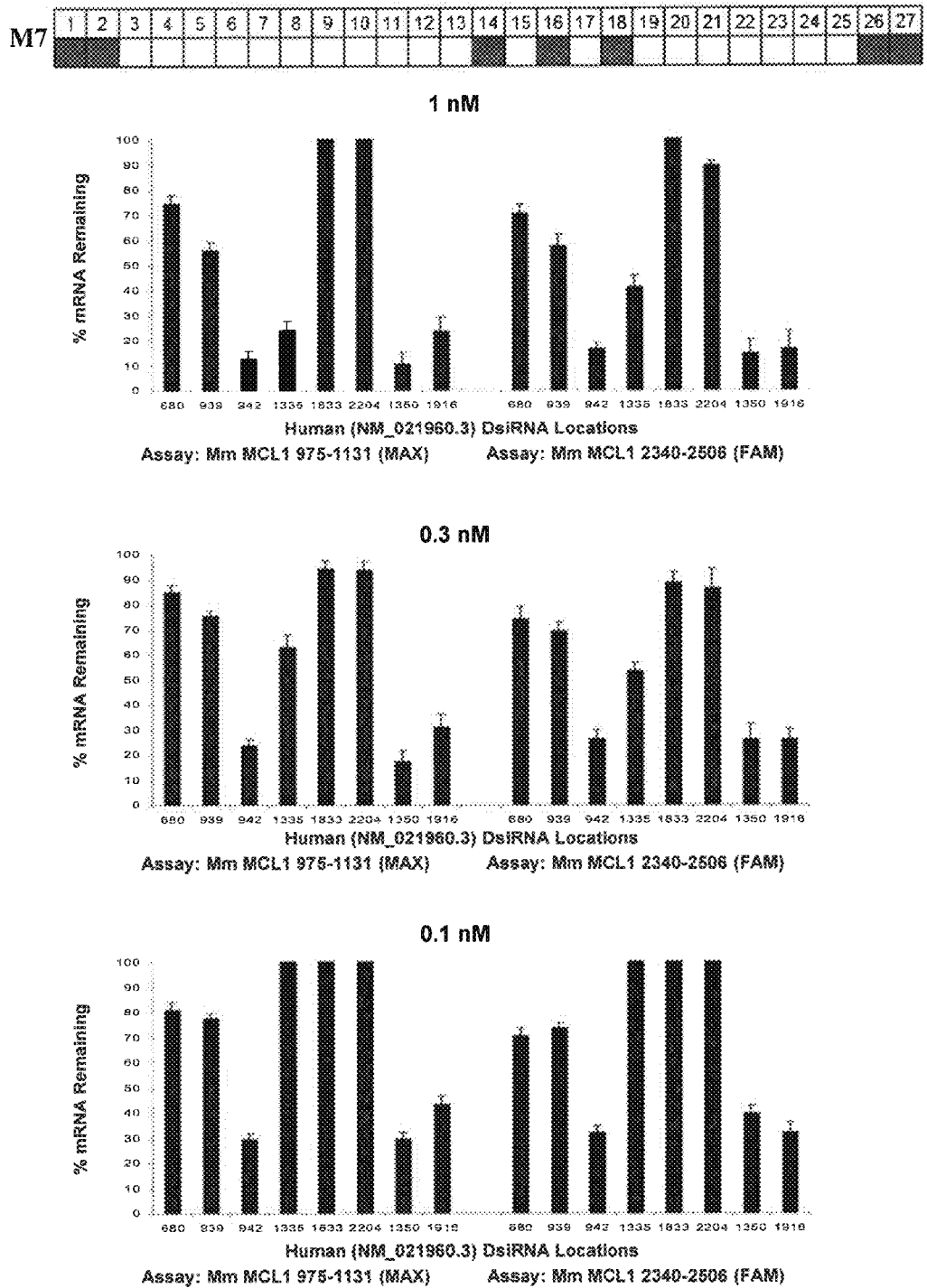
Figures 7, 8:
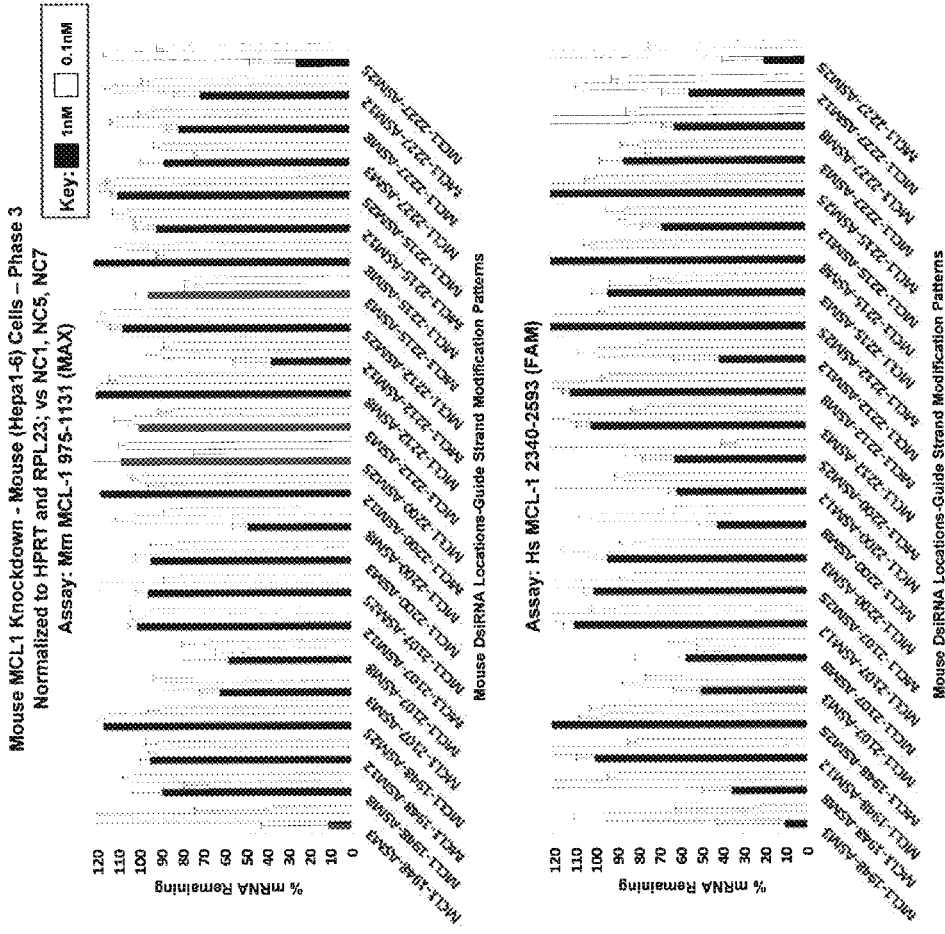
Figures 7, 8, 9:
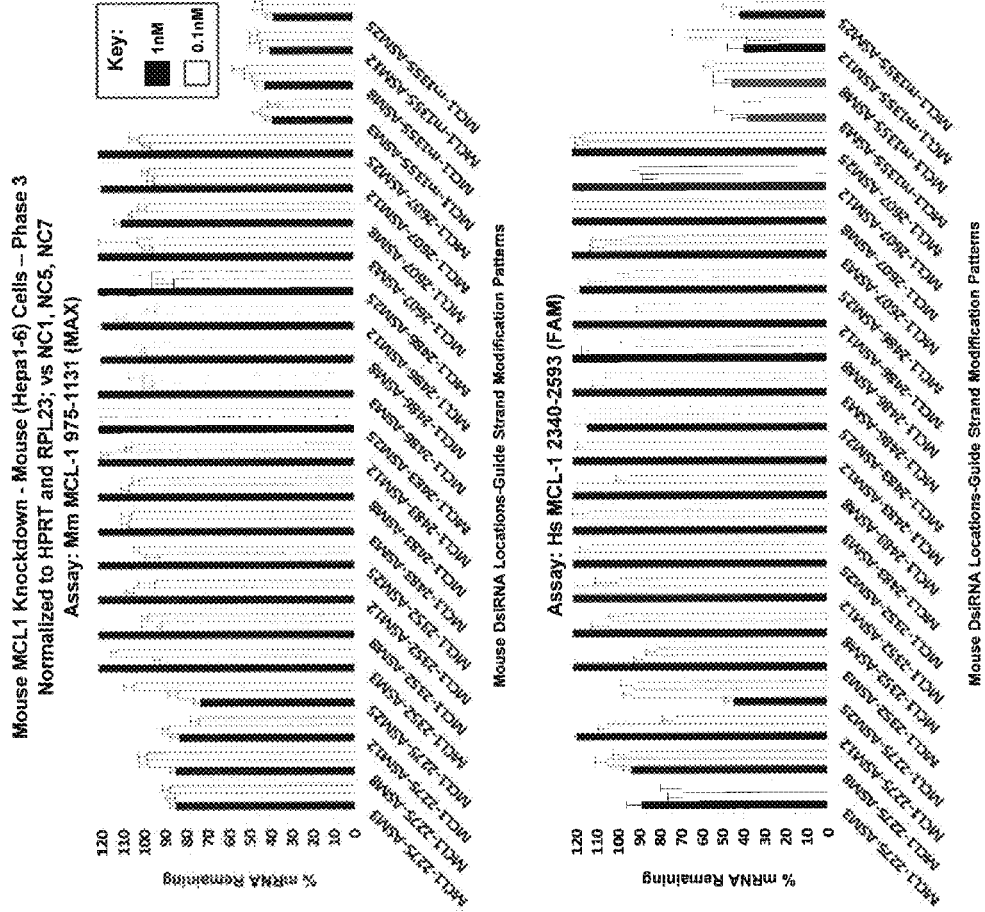
Figures 2, 8:
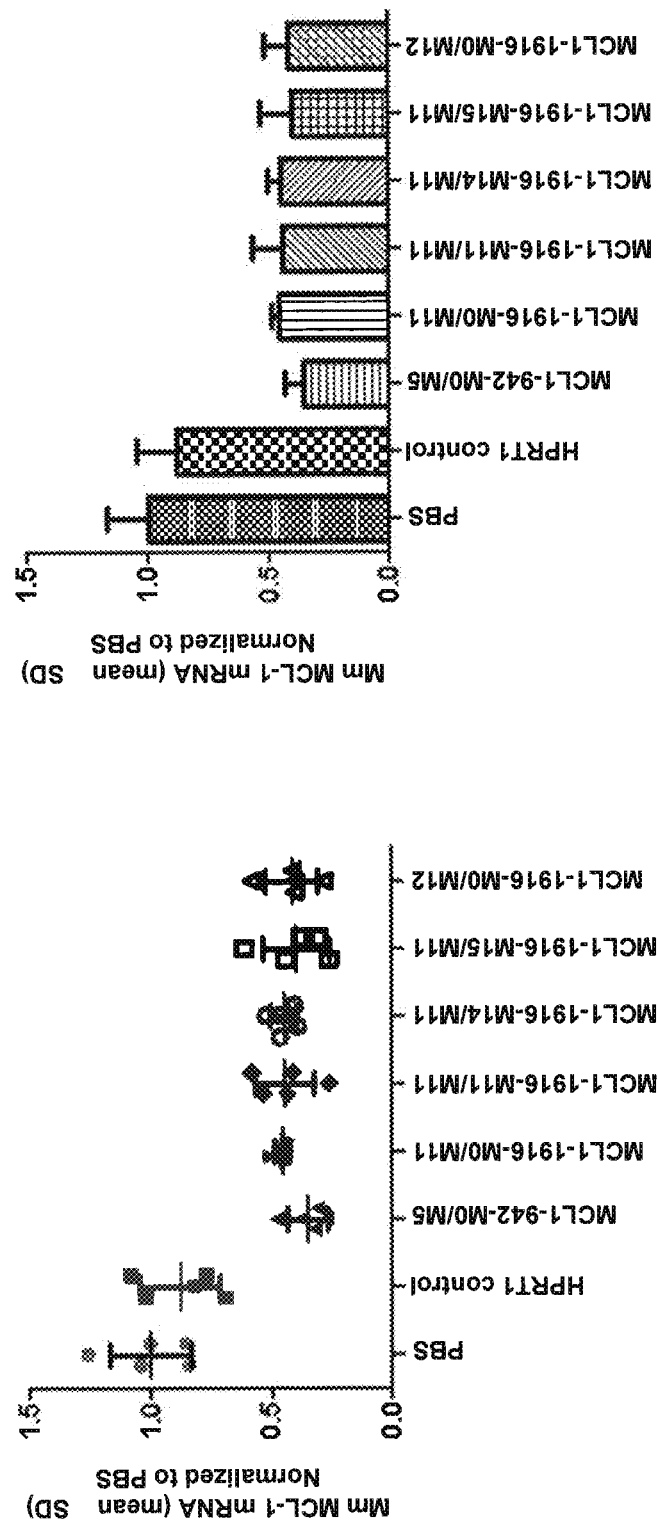
Figures 1, 9:
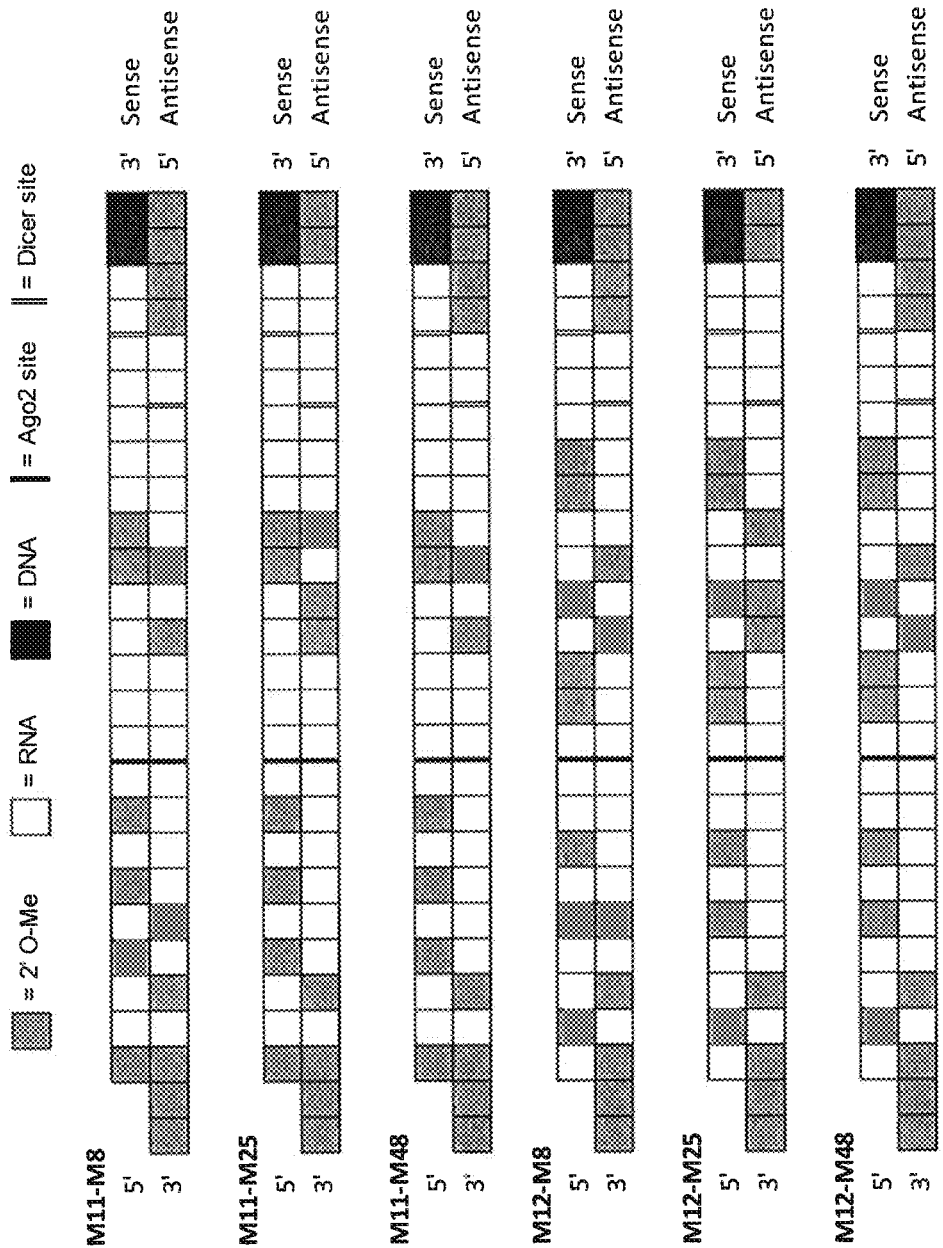
Figures 3, 9:
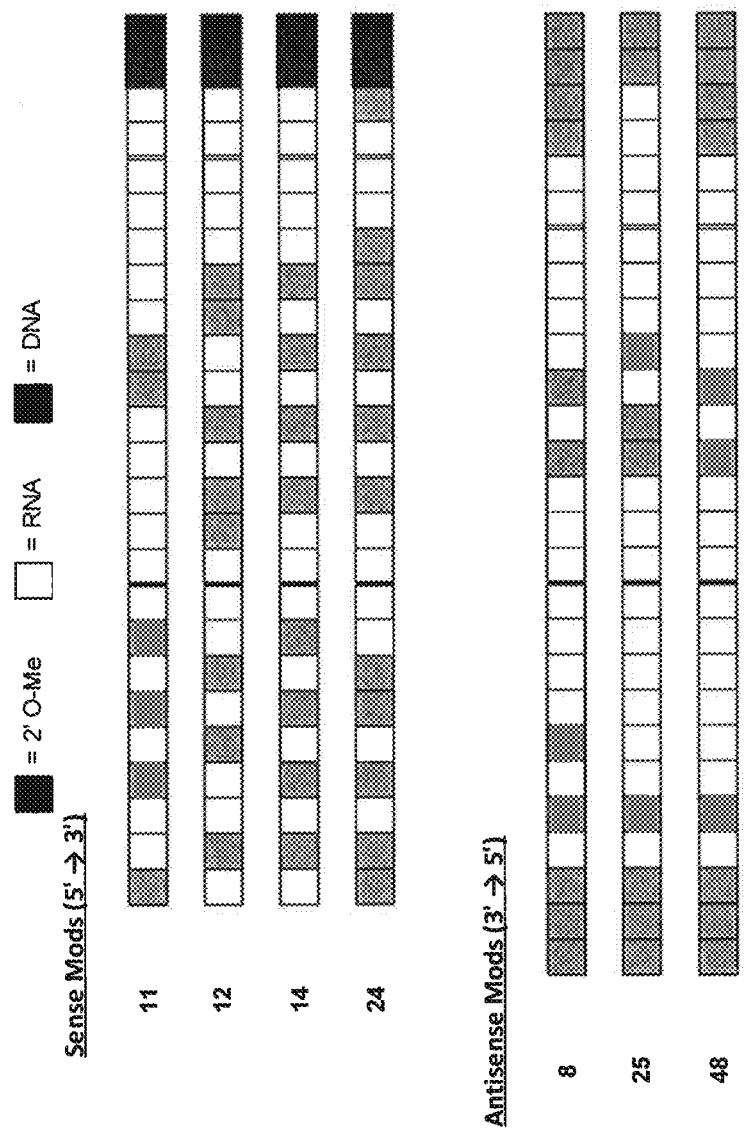
Figures 5, 9:
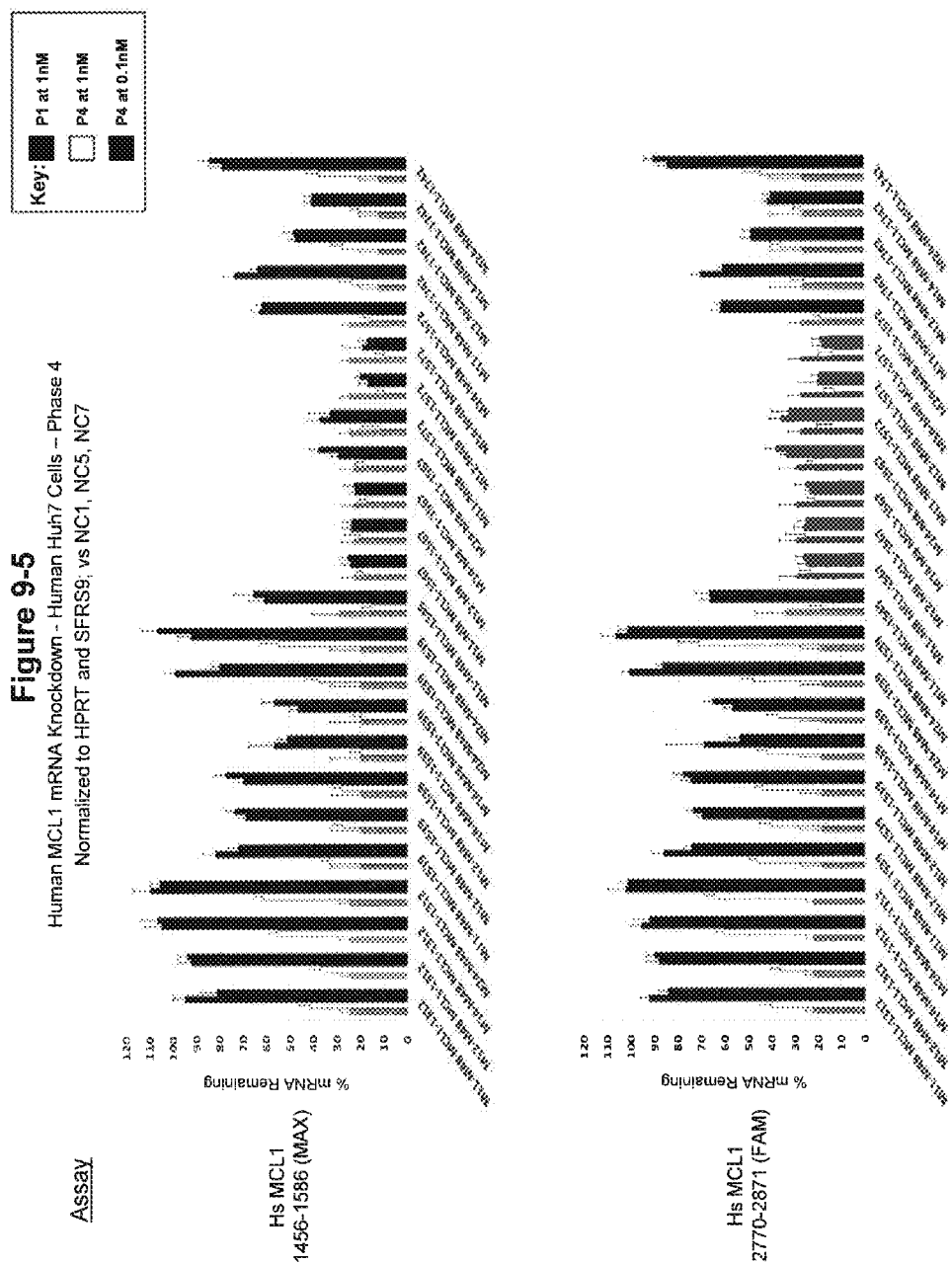
Figures 7, 9:
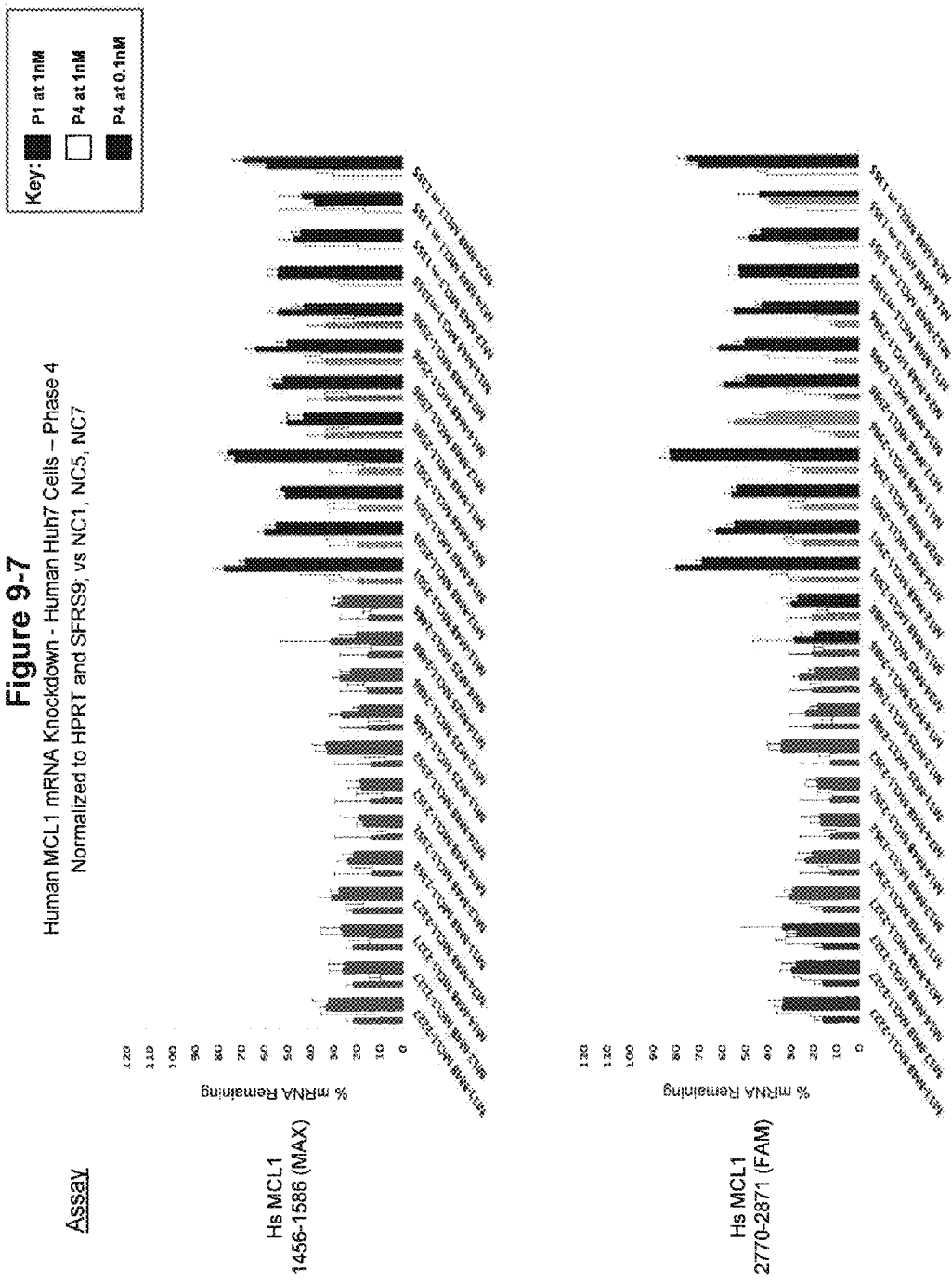

To test the activity of a DsiRNA directed against MCL1 in vivo, CD1 mice were administered the MCL1-targeting DsiRNAs MCL1-942-M0/M5, MCL1-1916-M0/M1, MCL1-1916-M11/M11, MCL1-1916-M14/M11, MCL1-1916-M15/M11 and MCL1-1916-M0/M12, with indicated modification patterns presented in FIG. 8-1. Mice were treated by i.v. tail vein injection with PBS (control vehicle), a control HPRT1-targeting DsiRNA, or these MCL1-targeting DsiRNAs. DsiRNAs were formulated in Invivofectamine® 2.0 (InVitrogen), and were administered at a dose of 10 mg/kg body weight (administered at time 0). Three days after administration, animals were sacrificed and tissues of interest (e.g., lung, liver, spleen, kidney, colon, etc.) were harvested. Results obtained for mouse liver tissue assays are shown in FIG. 8-2, where all MCL-11-targeting DisRNAs significantly reduced MCL1 mRNA levels in vivo, by greater than 50% at 72 hours after DsiRNA dosing. The left-hand and right-hand panels of FIG. 8-2 reflect distinct presentations of the results.

The in vivo knockdown efficacy of MCL-1-targeting DsiRNAs in harvested tissue (here, liver) was thereby assessed and confirmed.

Example 9: Additionally Modified Forms of MCL1-Targeting DsiRNAs Reduce MCL1 Levels In Vitro 23 human MCL1-targeting DsiRNAs (MCL1-680, MCL1-839, MCL1-939, MCL1-942, MCL1-1086, MCL1-1095, MCL1-1312, MCL1-1539, MCL1-1545, MCL1-1567, MCL1-1572, MCL1-1742, MCL1-1833, MCL1-1875, MCL1-1916, MCL1-1948, MCL1-1969, MCL1-2215, MCL1-2227, MCL1-2352, MCL1-2486, MCL1-2501 and MCL1-2596) and one mouse MCL1-targeting DsiRNA (MCL1-m1355) were prepared with both 2'-O-methyl passenger strand and guide strand modification patterns with individual modification patterns presented in FIGS. 9-1 to 9-3. For each of the 24 DsiRNA sequences, DsiRNAs possessing passenger strand modification patterns selected from SM11, SM12, SM14 and SM24 (referred to as simply "M11", "M12", "M14" and "M24" in FIGS. 9-1 to 9-7, where the passenger strand modification pattern is the first modification pattern listed, followed by the guide strand modification pattern, e.g., "M11-M48" in FIGS. 9-4 to 9-7 indicates a duplex possessing passenger strand modification pattern "SM11" and guide strand modification pattern "M48") and the "M48" guide strand modification pattern were assayed for MCL1 inhibition in human Huh7 cells at 1.0 nM and 0.1 nM (in duplicate) concentrations in the environment of the Huh7 cells. Results of these experiments are presented as histograms in FIGS. 9-4 to 9-7. As in certain of the above Examples, in general, the 24 DsiRNA sequences exhibited a trend towards reduced efficacy of MCL1 inhibition as the extent of 2'-O-methyl modification of both passenger and guide strands increased. However, for many of the DsiRNA sequences examined, a combination of passenger and guide strand modification patterns could be identified that allowed the DsiRNA to retain significant MCL1 inhibitory efficacy in vitro. It was also notable that some of these DsiRNAs (e.g., MCL1-939, MCL1-1567, MCL1-1833, MCL1-1916, MCL1-1948, MCL1-1969, MCL1-2227 and MCL1-2486) exhibited no apparent decline in MCL1 inhibitory efficacy in even the most highly modified states examined. Thus, such active modified DsiRNA sequences possess modification patterns believed to be capable of stabilizing such DsiRNAs and/or reducing immunogenicity of such DsiRNAs when therapeutically administered to a subject in vivo.

In certain embodiments, double stranded nucleic acids were selected that target the following 27 nucleotide target sequences in MCL1 mRNA:

TABLE 13

MCL1 27 Nucleotide mRNA Target Sequences of Select dsRNAs

| Human MCL1 Duplex Name | 27 Nucleotide Target Sequence | SEQ ID NO: |
|---|---|---|
| MCL1-680 | ACCGGCAGUCGCUGGAGAUUAUCUCUC | 1899 |
| MCL1-839 | UCCAAGGCAUGCUUCGGAAACUGGACA | 1917 |
| MCL1-939 | GGGCAGGAUUGUGACUCUCAUUUCUUU | 1920 |
| MCL1-1086 | AGGCUGGGAUGGGUUUGUGGAGUUCUU | 1946 |
| MCL1-1095 | UGGGUUUGUGGAGUUCUUCCAUGUAGA | 1955 |
| MCL1-1276 | UUGGACUCCAAGCUGUAACUUCCUAGA | 1968 |
| MCL1-1312 | UAGCAACCUAGCCAGAAAAGCAAGUGG | 2789 |
| MCL1-1466 | GGAGGACUUUUAGAUUUAGUGAAGAUG | 1987 |
| MCL1-1539 | CAGUAGCCAGGCAAGUCAUAGAAUUGA | 2798 |
| MCL1-1545 | CCAGGCAAGUCAUAGAAUUGAUUACCC | 1991 |
| MCL1-1567 | UACCCGCCGAAUUCAUUAAUUUACUGU | 1993 |
| MCL1-1572 | GCCGAAUUCAUUAAUUUACUGUAGUGU | 1994 |
| MCL1-1742 | UCAGGACUUUUAUACCUGUUAUACUUU | 2806 |
| MCL1-1833 | CUCAGUAAUUAGUUAUGAAUAUGGAUA | 2007 |
| MCL1-1875 | ACAGCUUGUAAAUGUAUUUGUAAAAAU | 2815 |
| MCL1-1916 | CAGAAAGUCUAUUUCUUUGAAACGAAG | 2014 |
| MCL1-1948 | AUCGAAUUUACAUUAGUUUUUUCAUA | 2016 |
| MCL1-1969 | UUCAUACCCUUUUGAACUUUGCAACUU | 2820 |
| MCL1-2215 | UGGAAAUUCUUUCACUUCAUUAUAUGC | 2829 |
| MCL1-2227 | CACUUCAUUAUAUGCAAGUUUUCAAUA | 2832 |

TABLE 13-continued

MCL1 27 Nucleotide mRNA Target Sequences of Select dsRNAs

| Human MCL1 Duplex Name | 27 Nucleotide Target Sequence | SEQ ID NO: |
|---|---|---|
| MCL1-2352 | AACUGGUGAAAUUUAAAGUGAAUUCAU | 2839 |
| MCL1-2486 | UUGUUUGCUUAAUAAAUUAUAAAAUGA | 2843 |
| MCL1-2501 | AUUAUAAAAUGAUGGCUUGGAAAAGCA | 2844 |
| MCL1-2596 | AAUAAAGCAAAUACUUACUGUUUUGUU | 2849 |

Select 21 nucleotide MCL1 mRNA target sequences corresponding to the above double stranded nucleic acids of Table 13 include:

TABLE 14

MCL1 21 Nucleotide mRNA Target Sequences of Select dsRNAs

| Human MCL1 Duplex Name | 21 Nucleotide Target Sequence | SEQ ID NO: |
|---|---|---|
| MCL1-680 | ACCGGCAGUCGCUGGAGAUUA | 1269 |
| MCL1-839 | UCCAAGGCAUGCUUCGGAAAC | 1287 |
| MCL1-939 | GGGCAGGAUUGUGACUCUCAU | 1290 |
| MCL1-1086 | AGGCUGGGAUGGGUUUGUGGA | 1316 |
| MCL1-1095 | UGGGUUUGUGGAGUUCUUCCA | 1325 |
| MCL1-1276 | UUGGACUCCAAGCUGUAACUU | 1338 |
| MCL1-1312 | UAGCAACCUAGCCAGAAAAGC | 2597 |
| MCL1-1466 | GGAGGACUUUUAGAUUUAGUG | 1357 |
| MCL1-1539 | CAGUAGCCAGGCAAGUCAUAG | 2606 |
| MCL1-1545 | CCAGGCAAGUCAUAGAAUUGA | 1361 |
| MCL1-1567 | UACCCGCCGAAUUCAUUAAUU | 1363 |
| MCL1-1572 | GCCGAAUUCAUUAAUUUACUG | 1364 |
| MCL1-1742 | UCAGGACUUUUAUACCUGUUA | 2614 |
| MCL1-1833 | CUCAGUAAUUAGUUAUGAAUA | 1377 |
| MCL1-1875 | ACAGCUUGUAAAUGUAUUUGU | 2623 |
| MCL1-1916 | CAGAAAGUCUAUUUCUUUGAA | 1384 |
| MCL1-1948 | AUCGAAUUUACAUUAGUUUUU | 1386 |
| MCL1-1969 | UUCAUACCCUUUUGAACUUUG | 2628 |
| MCL1-2215 | UGGAAAUUCUUUCACUUCAUU | 2637 |
| MCL1-2227 | CACUUCAUUAUAUGCAAGUUU | 2640 |
| MCL1-2352 | AACUGGUGAAAUUUAAAGUGA | 2647 |
| MCL1-2486 | UUGUUUGCUUAAUAAAUUAUA | 2651 |
| MCL1-2501 | AUUAUAAAAUGAUGGCUUGGA | 2652 |
| MCL1-2596 | AAUAAAGCAAAUACUUACUGU | 2657 |

19 nucleotide MCL1 mRNA target sequences corresponding to the above double stranded nucleic acids of Table 14 include:

TABLE 15

MCL1 19 Nucleotide mRNA Target Sequences of Select dsRNAs

| Human MCL1 Duplex Name | 19 Nucleotide Target Sequence | SEQ ID NO: |
|---|---|---|
| MCL1-680 | ACCGGCAGUCGCUGGAGAU | 2894 |
| MCL1-680 | CCGGCAGUCGCUGGAGAUU | 2895 |
| MCL1-680 | CGGCAGUCGCUGGAGAUUA | 2896 |
| MCL1-839 | UCCAAGGCAUGCUUCGGAA | 2897 |
| MCL1-839 | CCAAGGCAUGCUUCGGAAA | 2898 |
| MCL1-839 | CAAGGCAUGCUUCGGAAAC | 2899 |
| MCL1-939 | GGGCAGGAUUGUGACUCUC | 2900 |
| MCL1-939 | GGCAGGAUUGUGACUCUCA | 2901 |
| MCL1-939 | GCAGGAUUGUGACUCUCAU | 2902 |
| MCL1-1086 | AGGCUGGGAUGGGUUUGUG | 2903 |
| MCL1-1086 | GGCUGGGAUGGGUUUGUGG | 2904 |
| MCL1-1086 | GCUGGGAUGGGUUUGUGGA | 2905 |
| MCL1-1095 | UGGGUUUGUGGAGUUCUUC | 2906 |
| MCL1-1095 | GGGUUUGUGGAGUUCUUCC | 2907 |
| MCL1-1095 | GGUUUGUGGAGUUCUUCCA | 2908 |
| MCL1-1276 | UUGGACUCCAAGCUGUAAC | 2909 |
| MCL1-1276 | UGGACUCCAAGCUGUAACU | 2910 |
| MCL1-1276 | GGACUCCAAGCUGUAACUU | 2911 |
| MCL1-1312 | UAGCAACCUAGCCAGAAAA | 2912 |
| MCL1-1312 | AGCAACCUAGCCAGAAAAG | 2913 |
| MCL1-1312 | GCAACCUAGCCAGAAAAGC | 2914 |
| MCL1-1466 | GGAGGACUUUUAGAUUUAG | 2915 |
| MCL1-1466 | GAGGACUUUUAGAUUUAGU | 2916 |
| MCL1-1466 | AGGACUUUUAGAUUUAGUG | 2917 |
| MCL1-1539 | CAGUAGCCAGGCAAGUCAU | 2918 |
| MCL1-1539 | AGUAGCCAGGCAAGUCAUA | 2919 |
| MCL1-1539 | GUAGCCAGGCAAGUCAUAG | 2920 |
| MCL1-1545 | CCAGGCAAGUCAUAGAAUU | 2921 |
| MCL1-1545 | CAGGCAAGUCAUAGAAUUG | 2922 |
| MCL1-1545 | AGGCAAGUCAUAGAAUUGA | 2923 |
| MCL1-1567 | UACCCGCCGAAUUCAUUAA | 2924 |
| MCL1-1567 | ACCCGCCGAAUUCAUUAAU | 2925 |
| MCL1-1567 | CCCGCCGAAUUCAUUAAUU | 2926 |
| MCL1-1572 | GCCGAAUUCAUUAAUUUAC | 2927 |
| MCL1-1572 | CCGAAUUCAUUAAUUUACU | 2928 |
| MCL1-1572 | CGAAUUCAUUAAUUUACUG | 2929 |
| MCL1-1742 | UCAGGACUUUUAUACCUGU | 2930 |
| MCL1-1742 | CAGGACUUUUAUACCUGUU | 2931 |
| MCL1-1742 | AGGACUUUUAUACCUGUUA | 2932 |
| MCL1-1833 | CUCAGUAAUUAGUUAUGAA | 2933 |
| MCL1-1833 | UCAGUAAUUAGUUAUGAAU | 2934 |
| MCL1-1833 | CAGUAAUUAGUUAUGAAUA | 2935 |
| MCL1-1875 | ACAGCUUGUAAAUGUAUUU | 2936 |
| MCL1-1875 | CAGCUUGUAAAUGUAUUUG | 2937 |
| MCL1-1875 | AGCUUGUAAAUGUAUUUGU | 2938 |
| MCL1-1916 | CAGAAAGUCUAUUUCUUUG | 2939 |
| MCL1-1916 | AGAAAGUCUAUUUCUUUGA | 2940 |
| MCL1-1916 | GAAAGUCUAUUUCUUUGAA | 2941 |
| MCL1-1948 | AUCGAAUUUACAUUAGUUU | 2942 |
| MCL1-1948 | UCGAAUUUACAUUAGUUUU | 2943 |
| MCL1-1948 | CGAAUUUACAUUAGUUUUU | 2944 |
| MCL1-1969 | UUCAUACCCUUUUGAACUU | 2945 |
| MCL1-1969 | UCAUACCCUUUUGAACUUU | 2946 |
| MCL1-1969 | CAUACCCUUUUGAACUUUG | 2947 |
| MCL1-2215 | UGGAAAUUCUUUCACUUCA | 2948 |
| MCL1-2215 | GGAAAUUCUUUCACUUCAU | 2949 |
| MCL1-2215 | GAAAUUCUUUCACUUCAUU | 2950 |
| MCL1-2227 | CACUUCAUUAUAUGCAAGU | 2951 |
| MCL1-2227 | ACUUCAUUAUAUGCAAGUU | 2952 |
| MCL1-2227 | CUUCAUUAUAUGCAAGUUU | 2953 |
| MCL1-2352 | AACUGGUGAAAUUUAAAGU | 2954 |
| MCL1-2352 | ACUGGUGAAAUUUAAAGUG | 2955 |
| MCL1-2352 | CUGGUGAAAUUUAAAGUGA | 2956 |
| MCL1-2486 | UUGUUUGCUUAAUAAAUUA | 2957 |
| MCL1-2486 | UGUUUGCUUAAUAAAUUAU | 2958 |
| MCL1-2486 | GUUUGCUUAAUAAAUUAUA | 2959 |
| MCL1-2501 | AUUAUAAAAUGAUGGCUUG | 2960 |
| MCL1-2501 | UUAUAAAAUGAUGGCUUGG | 2961 |
| MCL1-2501 | UAUAAAAUGAUGGCUUGGA | 2962 |
| MCL1-2596 | AAUAAAGCAAAUACUUACU | 2963 |
| MCL1-2596 | AUAAAGCAAAUACUUACUG | 2964 |
| MCL1-2596 | UAAAGCAAAUACUUACUGU | 2965 |

Certain selections of 27 nucleotide MCL1 mRNA targets included the following:

TABLE 16

MCL1 27 Nucleotide mRNA Target Sequences of Further Selected dsRNAs

| Human MCL1 Duplex Name | 27 Nucleotide Target Sequence | SEQ ID NO: |
|---|---|---|
| MCL1-1095 | UGGGUUUGUGGAGUUCUUCCAUGUAGA | 1955 |
| MCL1-1312 | UAGCAACCUAGCCAGAAAAGCAAGUGG | 2789 |
| MCL1-1466 | GGAGGACUUUUAGAUUUAGUGAAGAUG | 1987 |
| MCL1-1539 | CAGUAGCCAGGCAAGUCAUAGAAUUGA | 2798 |
| MCL1-1545 | CCAGGCAAGUCAUAGAAUUGAUUACCC | 1991 |
| MCL1-1567 | UACCCGCCGAAUUCAUUAAUUUACUGU | 1993 |
| MCL1-1572 | GCCGAAUUCAUUAAUUUACUGUAGUGU | 1994 |
| MCL1-1742 | UCAGGACUUUUAUACCUGUUAUACUUU | 2806 |
| MCL1-1948 | AUCGAAUUUACAUUAGUUUUUUUCAUA | 2016 |
| MCL1-1969 | UUCAUACCCUUUUGAACUUUGCAACUU | 2820 |
| MCL1-2215 | UGGAAAUUCUUUCACUUCAUUAUAUGC | 2829 |
| MCL1-2352 | AACUGGUGAAAUUUAAAGUGAAUUCAU | 2839 |
| MCL1-2486 | UUGUUUGCUUAAUAAAUUAUAAAAUGA | 2843 |
| MCL1-2501 | AUUAUAAAAUGAUGGCUUGGAAAAGCA | 2844 |

Certain additional selections of 21 nucleotide MCL1 mRNA targets included the following:

TABLE 17

MCL1 21 Nucleotide mRNA Target Sequences of Further Selected dsRNAs

| Human MCL1 Duplex Name | 21 Nucleotide Target Sequence | SEQ ID NO: |
|---|---|---|
| MCL1-1095 | UGGGUUUGUGGAGUUCUUCCA | 1325 |
| MCL1-1312 | UAGCAACCUAGCCAGAAAAGC | 2597 |
| MCL1-1466 | GGAGGACUUUUAGAUUUAGUG | 1357 |
| MCL1-1539 | CAGUAGCCAGGCAAGUCAUAG | 2606 |
| MCL1-1545 | CCAGGCAAGUCAUAGAAUUGA | 1361 |
| MCL1-1567 | UACCCGCCGAAUUCAUUAAUU | 1363 |
| MCL1-1572 | GCCGAAUUCAUUAAUUUACUG | 1364 |
| MCL1-1742 | UCAGGACUUUUAUACCUGUUA | 2614 |
| MCL1-1948 | AUCGAAUUUACAUUAGUUUUU | 1386 |
| MCL1-1969 | UUCAUACCCUUUUGAACUUUG | 2628 |
| MCL1-2215 | UGGAAAUUCUUUCACUUCAUU | 2637 |
| MCL1-2227 | CACUUCAUUAUAUGCAAGUUU | 2640 |
| MCL1-2352 | AACUGGUGAAAUUUAAAGUGA | 2647 |
| MCL1-2486 | UUGUUUGCUUAAUAAAUUAUA | 2651 |
| MCL1-2501 | AUUAUAAAAUGAUGGCUUGGA | 2652 |

Certain further selections of 19 nucleotide MCL1 mRNA targets included the following:

TABLE 18

MCL1 19 Nucleotide mRNA Target Sequences of Further Selected dsRNAs

| Human MCL1 Duplex Name | 19 Nucleotide Target Sequence | SEQ ID NO: |
|---|---|---|
| MCL1-680 | ACCGGCAGUCGCUGGAGAU | 2894 |
| MCL1-680 | CCGGCAGUCGCUGGAGAUU | 2895 |
| MCL1-839 | CCAAGGCAUGCUUCGGAAA | 2898 |
| MCL1-839 | CAAGGCAUGCUUCGGAAAC | 2899 |
| MCL1-1086 | GGCUGGGAUGGGUUUGUGG | 2904 |
| MCL1-1086 | GCUGGGAUGGGUUUGUGGA | 2905 |
| MCL1-1095 | UGGGUUUGUGGAGUUCUUC | 2906 |
| MCL1-1095 | GGGUUUGUGGAGUUCUUCC | 2907 |
| MCL1-1095 | GGUUUGUGGAGUUCUUCCA | 2908 |
| MCL1-1276 | UUGGACUCCAAGCUGUAAC | 2909 |
| MCL1-1276 | UGGACUCCAAGCUGUAACU | 2910 |
| MCL1-1312 | UAGCAACCUAGCCAGAAAA | 2912 |
| MCL1-1312 | AGCAACCUAGCCAGAAAAG | 2913 |
| MCL1-1312 | GCAACCUAGCCAGAAAAGC | 2914 |
| MCL1-1466 | GGAGGACUUUUAGAUUUAG | 2915 |
| MCL1-1466 | GAGGACUUUUAGAUUUAGU | 2916 |
| MCL1-1466 | AGGACUUUUAGAUUUAGUG | 2917 |
| MCL1-1539 | CAGUAGCCAGGCAAGUCAU | 2918 |
| MCL1-1539 | AGUAGCCAGGCAAGUCAUA | 2919 |
| MCL1-1539 | GUAGCCAGGCAAGUCAUAG | 2920 |
| MCL1-1545 | CCAGGCAAGUCAUAGAAUU | 2921 |
| MCL1-1545 | CAGGCAAGUCAUAGAAUUG | 2922 |
| MCL1-1545 | AGGCAAGUCAUAGAAUUGA | 2923 |
| MCL1-1567 | UACCCGCCGAAUUCAUUAA | 2924 |
| MCL1-1567 | ACCCGCCGAAUUCAUUAAU | 2925 |
| MCL1-1567 | CCCGCCGAAUUCAUUAAUU | 2926 |
| MCL1-1572 | GCCGAAUUCAUUAAUUUAC | 2927 |
| MCL1-1572 | CCGAAUUCAUUAAUUUACU | 2928 |
| MCL1-1572 | CGAAUUCAUUAAUUUACUG | 2929 |
| MCL1-1742 | UCAGGACUUUUAUACCUGU | 2930 |
| MCL1-1742 | CAGGACUUUUAUACCUGUU | 2931 |
| MCL1-1742 | AGGACUUUUAUACCUGUUA | 2932 |
| MCL1-1875 | CAGCUUGUAAAUGUAUUUG | 2937 |
| MCL1-1875 | AGCUUGUAAAUGUAUUUGU | 2938 |
| MCL1-1948 | AUCGAAUUUACAUUAGUUU | 2942 |
| MCL1-1948 | UCGAAUUUACAUUAGUUUU | 2943 |
| MCL1-1948 | CGAAUUUACAUUAGUUUUU | 2944 |

TABLE 18-continued

MCL1 19 Nucleotide mRNA Target Sequences of Further Selected dsRNAs

| Human MCL1 Duplex Name | 19 Nucleotide Target Sequence | SEQ ID NO: |
|---|---|---|
| MCL1-1969 | UUCAUACCCUUUUGAACUU | 2945 |
| MCL1-1969 | UCAUACCCUUUUGAACUUU | 2946 |
| MCL1-1969 | CAUACCCUUUUGAACUUUG | 2947 |
| MCL1-2215 | UGGAAAUUCUUUCACUUCA | 2948 |
| MCL1-2215 | GGAAAUUCUUUCACUUCAU | 2949 |
| MCL1-2215 | GAAAUUCUUUCACUUCAUU | 2950 |
| MCL1-2227 | CACUUCAUUAUAUGCAAGU | 2951 |
| MCL1-2227 | ACUUCAUUAUAUGCAAGUU | 2952 |
| MCL1-2227 | CUUCAUUAUAUGCAAGUUU | 2953 |
| MCL1-2352 | AACUGGUGAAAUUUAAAGU | 2954 |
| MCL1-2352 | ACUGGUGAAAUUUAAAGUG | 2955 |
| MCL1-2352 | CUGGUGAAAUUUAAAGUGA | 2956 |
| MCL1-2486 | UUGUUUGCUUAAUAAAUUA | 2957 |
| MCL1-2486 | UGUUUGCUUAAUAAAUUAU | 2958 |
| MCL1-2486 | GUUUGCUUAAUAAAUUAUA | 2959 |
| MCL1-2501 | AUUAUAAAAUGAUGGCUUG | 2960 |
| MCL1-2501 | UUAUAAAAUGAUGGCUUGG | 2961 |
| MCL1-2501 | UAUAAAAUGAUGGCUUGGA | 2962 |
| MCL1-2596 | UAAAGCAAAUACUUACUGU | 2965 |

Additional selections of 27 nucleotide MCL1 mRNA targets included the following:

TABLE 19

MCL1 27 Nucleotide mRNA Target Sequences of Additonal Selected dsRNAs

| Human MCL1 Duplex Name | 27 Nucleotide Target Sequence | SEQ ID NO: |
|---|---|---|
| MCL1-1086 | AGGCUGGGAUGGGUUUGUGGAGUUCUU | 1946 |
| MCL1-1095 | UGGGUUUGUGGAGUUCUUCCAUGUAGA | 1955 |
| MCL1-1312 | UAGCAACCUAGCCAGAAAAGCAAGUGG | 2789 |
| MCL1-1466 | GGAGGACUUUUAGAUUUAGUGAAGAUG | 1987 |
| MCL1-1539 | CAGUAGCCAGGCAAGUCAUAGAAUUGA | 2798 |
| MCL1-1545 | CCAGGCAAGUCAUAGAAUUGAUUACCC | 1991 |
| MCL1-1567 | UACCCGCCGAAUUCAUUAAUUUACUGU | 1993 |
| MCL1-1572 | GCCGAAUUCAUUAAUUUACUGUAGUGU | 1994 |
| MCL1-1742 | UCAGGACUUUUAUACCUGUUAUACUUU | 2806 |
| MCL1-1875 | ACAGCUUGUAAAUGUAUUUGUAAAAAU | 2815 |
| MCL1-1948 | AUCGAAUUUACAUUAGUUUUUUCAUA | 2016 |
| MCL1-1969 | UUCAUACCCUUUUGAACUUUGCAACUU | 2820 |
| MCL1-2215 | UGGAAAUUCUUUCACUUCAUUAUAUGC | 2829 |
| MCL1-2352 | AACUGGUGAAAUUUAAAGUGAAUUCAU | 2839 |
| MCL1-2486 | UUGUUUGCUUAAUAAAUUAUAAAAUGA | 2843 |
| MCL1-2501 | AUUAUAAAAUGAUGGCUUGGAAAAGCA | 2844 |
| MCL1-2596 | AAUAAAGCAAAUACUUACUGUUUUGUU | 2849 |

Further selections of 21 nucleotide MCL1 mRNA targets included the following:

TABLE 20

MCL1 21 Nucleotide mRNA Target Sequences of Additional Selected dsRNAs

| Human MCL1 Duplex Name | 21 Nucleotide Target Sequence | SEQ ID NO: |
|---|---|---|
| MCL1-680 | ACCGGCAGUCGCUGGAGAUUA | 1269 |
| MCL1-839 | UCCAAGGCAUGCUUCGGAAAC | 1287 |
| MCL1-1086 | AGGCUGGGAUGGGUUUGUGGA | 1316 |
| MCL1-1095 | UGGGUUUGUGGAGUUCUUCCA | 1325 |
| MCL1-1312 | UAGCAACCUAGCCAGAAAAGC | 2597 |
| MCL1-1466 | GGAGGACUUUUAGAUUUAGUG | 1357 |
| MCL1-1539 | CAGUAGCCAGGCAAGUCAUAG | 2606 |
| MCL1-1545 | CCAGGCAAGUCAUAGAAUUGA | 1361 |
| MCL1-1567 | UACCCGCCGAAUUCAUUAAUU | 1363 |
| MCL1-1572 | GCCGAAUUCAUUAAUUUACUG | 1364 |
| MCL1-1742 | UCAGGACUUUUAUACCUGUUA | 2614 |
| MCL1-1875 | ACAGCUUGUAAAUGUAUUUGU | 2623 |
| MCL1-1948 | AUCGAAUUUACAUUAGUUUUU | 1386 |
| MCL1-1969 | UUCAUACCCUUUUGAACUUUG | 2628 |
| MCL1-2215 | UGGAAAUUCUUUCACUUCAUU | 2637 |
| MCL1-2227 | CACUUCAUUAUAUGCAAGUUU | 2640 |
| MCL1-2352 | AACUGGUGAAAUUUAAAGUGA | 2647 |
| MCL1-2486 | UUGUUUGCUUAAUAAAUUAUA | 2651 |
| MCL1-2501 | AUUAUAAAAUGAUGGCUUGGA | 2652 |
| MCL1-2596 | AAUAAAGCAAAUACUUACUGU | 2657 |

Additional further selections of 19 nucleotide MCL1 mRNA targets included the following:

TABLE 21

MCL1 19 Nucleotide mRNA Target Sequences of Additional Selected dsRNAs

| Human MCL1 Duplex Name | 19 Nucleotide Target Sequence | SEQ ID NO: |
|---|---|---|
| MCL1-680 | ACCGGCAGUCGCUGGAGAU | 2894 |
| MCL1-680 | CCGGCAGUCGCUGGAGAUU | 2895 |
| MCL1-680 | CGGCAGUCGCUGGAGAUUA | 2896 |
| MCL1-839 | UCCAAGGCAUGCUUCGGAA | 2897 |
| MCL1-839 | CCAAGGCAUGCUUCGGAAA | 2898 |
| MCL1-839 | CAAGGCAUGCUUCGGAAAC | 2899 |
| MCL1-939 | GGCAGGAUUGUGACUCUCA | 2901 |
| MCL1-939 | GCAGGAUUGUGACUCUCAU | 2902 |
| MCL1-1086 | AGGCUGGGAUGGGUUUGUG | 2903 |
| MCL1-1086 | GGCUGGGAUGGGUUUGUGG | 2904 |
| MCL1-1086 | GCUGGGAUGGGUUUGUGGA | 2905 |
| MCL1-1095 | UGGGUUUGUGGAGUUCUUC | 2906 |
| MCL1-1095 | GGGUUUGUGGAGUUCUUCC | 2907 |
| MCL1-1095 | GGUUUGUGGAGUUCUUCCA | 2908 |
| MCL1-1276 | UUGGACUCCAAGCUGUAAC | 2909 |
| MCL1-1276 | UGGACUCCAAGCUGUAACU | 2910 |
| MCL1-1312 | UAGCAACCUAGCCAGAAAA | 2912 |
| MCL1-1312 | AGCAACCUAGCCAGAAAAG | 2913 |
| MCL1-1312 | GCAACCUAGCCAGAAAAGC | 2914 |
| MCL1-1466 | GGAGGACUUUUAGAUUUAG | 2915 |
| MCL1-1466 | GAGGACUUUUAGAUUUAGU | 2916 |
| MCL1-1466 | AGGACUUUUAGAUUUAGUG | 2917 |
| MCL1-1539 | CAGUAGCCAGGCAAGUCAU | 2918 |
| MCL1-1539 | AGUAGCCAGGCAAGUCAUA | 2919 |
| MCL1-1539 | GUAGCCAGGCAAGUCAUAG | 2920 |
| MCL1-1545 | CCAGGCAAGUCAUAGAAUU | 2921 |
| MCL1-1545 | CAGGCAAGUCAUAGAAUUG | 2922 |
| MCL1-1545 | AGGCAAGUCAUAGAAUUGA | 2923 |
| MCL1-1567 | UACCCGCCGAAUUCAUUAA | 2924 |
| MCL1-1567 | ACCCGCCGAAUUCAUUAAU | 2925 |
| MCL1-1567 | CCCGCCGAAUUCAUUAAUU | 2926 |
| MCL1-1572 | GCCGAAUUCAUUAAUUUAC | 2927 |
| MCL1-1572 | CCGAAUUCAUUAAUUUACU | 2928 |
| MCL1-1572 | CGAAUUCAUUAAUUUACUG | 2929 |
| MCL1-1742 | UCAGGACUUUUAUACCUGU | 2930 |
| MCL1-1742 | CAGGACUUUUAUACCUGUU | 2931 |
| MCL1-1742 | AGGACUUUUAUACCUGUUA | 2932 |
| MCL1-1833 | CUCAGUAAUUAGUUAUGAA | 2933 |
| MCL1-1833 | UCAGUAAUUAGUUAUGAAU | 2934 |
| MCL1-1875 | ACAGCUUGUAAAUGUAUUU | 2936 |
| MCL1-1875 | CAGCUUGUAAAUGUAUUUG | 2937 |
| MCL1-1875 | AGCUUGUAAAUGUAUUUGU | 2938 |
| MCL1-1948 | AUCGAAUUUACAUUAGUUU | 2942 |
| MCL1-1948 | UCGAAUUUACAUUAGUUUU | 2943 |
| MCL1-1948 | CGAAUUUACAUUAGUUUUU | 2944 |
| MCL1-1969 | UUCAUACCCUUUUGAACUU | 2945 |
| MCL1-1969 | UCAUACCCUUUUGAACUUU | 2946 |
| MCL1-1969 | CAUACCCUUUUGAACUUUG | 2947 |
| MCL1-2215 | UGGAAAUUCUUUCACUUCA | 2948 |
| MCL1-2215 | GGAAAUUCUUUCACUUCAU | 2949 |
| MCL1-2215 | GAAAUUCUUUCACUUCAUU | 2950 |
| MCL1-2227 | CACUUCAUUAUAUGCAAGU | 2951 |
| MCL1-2227 | ACUUCAUUAUAUGCAAGUU | 2952 |
| MCL1-2227 | CUUCAUUAUAUGCAAGUUU | 2953 |
| MCL1-2352 | AACUGGUGAAAUUUAAAGU | 2954 |
| MCL1-2352 | ACUGGUGAAAUUUAAAGUG | 2955 |
| MCL1-2352 | CUGGUGAAAUUUAAAGUGA | 2956 |
| MCL1-2486 | UUGUUUGCUUAAUAAAUUA | 2957 |
| MCL1-2486 | UGUUUGCUUAAUAAAUUAU | 2958 |
| MCL1-2486 | GUUUGCUUAAUAAAUUAUA | 2959 |
| MCL1-2501 | AUUAUAAAAUGAUGGCUUG | 2960 |
| MCL1-2501 | UUAUAAAAUGAUGGCUUGG | 2961 |
| MCL1-2501 | UAUAAAAUGAUGGCUUGGA | 2962 |
| MCL1-2596 | AAUAAAGCAAAUACUUACU | 2963 |
| MCL1-2596 | AUAAAGCAAAUACUUACUG | 2964 |
| MCL1-2596 | UAAAGCAAAUACUUACUGU | 2965 |

More selections of 27 nucleotide MCL1 mRNA targets included the following:

TABLE 22

MCL1 27 Nucleotide Selected mRNA Target Sequences

| Human MCL1 Duplex Name | 27 Nucleotide Target Sequence | SEQ ID NO: |
|---|---|---|
| MCL1-680 | ACCGGCAGUCGCUGGAGAUUAUCUCUC | 1899 |
| MCL1-839 | UCCAAGGCAUGCUUCGGAAACUGGACA | 1917 |

TABLE 22-continued

MCL1 27 Nucleotide Selected mRNA Target Sequences

| Human MCL1 Duplex Name | 27 Nucleotide Target Sequence | SEQ ID NO: |
|---|---|---|
| MCL1-939 | GGGCAGGAUUGUGACUCUCAUUUCUUU | 1920 |
| MCL1-1086 | AGGCUGGGAUGGGUUUGUGGAGUUCUU | 1946 |
| MCL1-1095 | UGGGUUUGUGGAGUUCUUCCAUGUAGA | 1955 |
| MCL1-1276 | UUGGACUCCAAGCUGUAACUUCCUAGA | 1968 |
| MCL1-1312 | UAGCAACCUAGCCAGAAAAGCAAGUGG | 2789 |
| MCL1-1466 | GGAGGACUUUUAGAUUUAGUGAAGAUG | 1987 |
| MCL1-1539 | CAGUAGCCAGGCAAGUCAUAGAAUUGA | 2798 |
| MCL1-1545 | CCAGGCAAGUCAUAGAAUUGAUUACCC | 1991 |
| MCL1-1567 | UACCCGCCGAAUUCAUUAAUUUACUGU | 1993 |
| MCL1-1572 | GCCGAAUUCAUUAAUUUACUGUAGUGU | 1994 |
| MCL1-1742 | UCAGGACUUUUAUACCUGUUAUACUUU | 2806 |
| MCL1-1916 | CAGAAAGUCUAUUUCUUUGAAACGAAG | 2014 |
| MCL1-1948 | AUCGAAUUUACAUUAGUUUUUUUCAUA | 2016 |
| MCL1-1969 | UUCAUACCCUUUUGAACUUUGCAACUU | 2820 |
| MCL1-2215 | UGGAAAUUCUUUCACUUCAUUAUAUGC | 2829 |
| MCL1-2227 | CACUUCAUUAUAUGCAAGUUUUCAAUA | 2832 |
| MCL1-2352 | AACUGGUGAAAUUUAAAGUGAAUUCAU | 2839 |
| MCL1-2486 | UUGUUUGCUUAAUAAAUUAUAAAAUGA | 2843 |
| MCL1-2501 | AUUAUAAAAUGAUGGCUUGGAAAAGCA | 2844 |
| MCL1-2596 | AAUAAAGCAAAUACUUACUGUUUUGUU | 2849 |

More selections of 19 nucleotide MCL1 mRNA targets included the following:

TABLE 23

MCL1 19 Nucleotide Selected mRNA Target Sequences

| Human MCL1 Duplex Name | 19 Nucleotide Target Sequence | SEQ ID NO: |
|---|---|---|
| MCL1-1875 | ACAGCUUGUAAAUGUAUUU | 2936 |
| MCL1-1875 | CAGCUUGUAAAUGUAUUUG | 2937 |

Example 10: Indications

The present body of knowledge in MCL1 research indicates the need for methods to assay MCL1 activity and for compounds that can regulate MCL1 expression for research, diagnostic, and therapeutic use. As described herein, the nucleic acid molecules of the present invention can be used in assays to diagnose disease state related to MCL1 levels. In addition, the nucleic acid molecules can be used to treat disease state related to MCL1 misregulation, levels, etc.

Particular disorders and disease states that can be associated with MCL1 expression modulation include, but are not limited to cancer and/or proliferative diseases, conditions, or disorders and other diseases, conditions or disorders that are related to or will respond to the levels of MCL1 in a cell or tissue, alone or in combination with other therapies, such as other immune cell-related disorders (e.g. inflammatory or autoimmune disorders). Particular degenerative and disease states that are associated with MCL1 expression modulation include but are not limited to, for example, renal, breast, lung, liver, ovarian, cervical, esophageal, oropharyngeal and pancreatic cancer.

Gemcitabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J.B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; 1-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies such as Herceptin; other therapeutics such as tarceva, sorafenib, obatoclax, apogossypolone, and navitoclax, and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 11: Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 12: Use of Additional Cell Culture Models to Evaluate the Down-Regulation of MCL1 Gene Expression A variety of endpoints have been used in cell culture models to look at MCL1-mediated effects after treatment with anti-MCL1 agents. Phenotypic endpoints include inhibition of cell proliferation, RNA expression, and reduction of Mcl-1 protein expression. Because MCL1 mutations are directly associated with increased growth of certain tumor cells, a growth endpoint for cell culture assays is can be used as a screen. There are several methods by which this endpoint can be measured. Following treatment of cells with DsiRNA, cells are allowed to grow (typically 5 days), after which the cell viability, the incorporation of bromodeoxyuridine (BrdU) into cellular DNA and/or the cell density are measured. The assay of cell density can be done in a 96-well format using commercially available fluorescent nucleic acid stains (such as Syto® 13 or CyQuant®). As a secondary, confirmatory endpoint, a DsiRNA-mediated decrease in the level of Mcl-1 protein expression can be evaluated using a MCL1-specific Western assay. The following are exemplary cell lines for use in such assays (e.g., assays performed as described in Schulze-Bergkamen et al., BMC Cancer 2006, 6:232): A549, H1299, HepG2, SNU398, HuH7, NCI-H196, NCI-H1975, MDA-MB-231, NCI-H441, Panc-1, MiaPaCa, BxPC3, DU-145, VCaP, MCF-7, U937, K562, HeLa, or T98G cells.

Example 13: Evaluation of Anti-MCL1 DsiRNA Efficacy in a Mouse Model of MCL1 Misregulation Anti-MCL1 DsiRNA chosen from in vitro assays can be further tested in mouse models, including, e.g., xenograft and other animal models as recited above. As referred to above, exemplary appropriate cell lines for use in xenograft assays include 518A2, MHCC97, A549, H1299, HepG2, SNU398, HuH7, NCI-H196, NCI-H1975, HT29, MKN-45, MDA-MB-231, NCI-H441, Panc-1, MiaPaCa, BxPC3, DU-145, M2182, VCaP, OvCar-3, MCF-7, U937, K562, HeLa, T98G, or SHP-77 cells. In one example, mice possessing misregulated (e.g., elevated) MCL1 levels are administered a DsiRNA agent of the present invention via hydrodynamic tail vein injection. 3-4 mice per group (divided based upon specific DsiRNA agent tested) are injected with 50 µg or 200 µg of DsiRNA. Levels of MCL1 RNA are evaluated using RT-qPCR. Additionally or alternatively, levels of MCL1 (e.g., Mcl-1 protein levels and/or cancer cell/tumor formation, growth or spread) can be evaluated using an art-recognized method, or phenotypes associated with misregulation of MCL1 (e.g., tumor formation, growth, metastasis, etc.) are monitored (optionally as a proxy for measurement of MCL1 transcript or Mcl-1 protein levels). Active DsiRNA in such animal models can also be subsequently tested in combination with standard chemotherapies.

Example 14: Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target MCL1 RNA allows the detection of mutations in a region of the MCL1 molecule, which alters the base-pairing and three-dimensional structure of the target MCL1 RNA. By using multiple DsiRNA molecules described in this invention, one can map nucleotide changes, which are important to RNA structure and function in vitro, as well as in cells and tissues. Cleavage of target MCL1 RNAs with DsiRNA molecules can be used to inhibit gene expression and define the role of specified gene products in the progression of a MCL1-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target MCL1 RNA are used for the assay. The first DsiRNA molecules (i.e., those that cleave only wild-type forms of target MCL1 RNA) are used to identify wild-type MCL1 RNA present in the sample and the second DsiRNA molecules (i.e., those that cleave only mutant or polymorphic forms of target RNA) are used to identify mutant or polymorphic MCL1 RNA in the sample. As reaction controls, synthetic substrates of both wild-type and mutant or polymorphic MCL1 RNA are cleaved by both DsiRNA molecules to demonstrate the relative DsiRNA efficiencies in the reactions and the absence of cleavage of the "non-targeted" MCL1 RNA species. The cleavage products from the synthetic substrates also serve to generate size markers for the analysis of wild-type and mutant MCL1 RNAs in the sample population. Thus, each analysis requires two DsiRNA molecules, two substrates and one unknown sample, which is combined into six reactions. The presence of cleavage products is determined using an RNase protection assay so that full-length and cleavage fragments of each MCL1 RNA can be analyzed in one lane of a polyacrylamide gel. It is not absolutely required to quantify the results to gain insight into the expression of mutant or polymorphic MCL1 RNAs and putative risk of MCL1-associated phenotypic changes in target cells. The expression of MCL1 mRNA whose protein product is implicated in the development of the phenotype (i.e., disease related/associated) is adequate to establish risk. If probes of comparable specific activity are used for both transcripts, then a qualitative comparison of MCL1 RNA levels is adequate and decreases the cost of the initial diagnosis. Higher mutant or polymorphic form to wild-type ratios are correlated with higher risk whether MCL1 RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (2973 sequences)

SEQ ID NO: 1 - DNA, 25 bp, Artificial Sequence
  Synthetic oligonucleotide
gccacuucucacuuccgcuuccutc

SEQ ID NO: 2 - DNA, 25 bp, Artificial Sequence
  Synthetic oligonucleotide
acuucucacuuccgcuuccuuccag

SEQ ID NO: 3 - DNA, 25 bp, Artificial Sequence
  Synthetic oligonucleotide
ggcggcgacuggcaauguuuggcct

SEQ ID NO: 4 - DNA, 25 bp, Artificial Sequence
  Synthetic oligonucleotide
cgcgguaaucggacucaaccucuac

SEQ ID NO: 5 - DNA, 25 bp, Artificial Sequence
  Synthetic oligonucleotide
agggcgacuuuuggcuacggagaag

SEQ ID NO: 6 - DNA, 25 bp, Artificial Sequence
  Synthetic oligonucleotide
gcgaggcugcuuuucuucgcgccca

SEQ ID NO: 7 - DNA, 25 bp, Artificial Sequence
  Synthetic oligonucleotide
ugguaauaacaccaguacggacggg

SEQ ID NO: 8 - DNA, 25 bp, Artificial Sequence
  Synthetic oligonucleotide
ggaggaggacgaguuguaccggcag

SEQ ID NO: 9 - DNA, 25 bp, Artificial Sequence
  Synthetic oligonucleotide
cggcagucgcuggagauuaucuctc

SEQ ID NO: 10 - DNA, 25 bp, Artificial Sequence
  Synthetic oligonucleotide
caaggacacaaagccaaugggcagg

SEQ ID NO: 11 - DNA, 25 bp, Artificial Sequence
  Synthetic oligonucleotide
ggaaggcgcuggagaccuuacgacg

SEQ ID NO: 12 - DNA, 25 bp, Artificial Sequence
  Synthetic oligonucleotide
ggcgugcagcgcaaccacgagacgg

SEQ ID NO: 13 - DNA, 25 bp, Artificial Sequence
  Synthetic oligonucleotide
gcgugcagcgcaaccacgagacggc

SEQ ID NO: 14 - DNA, 25 bp, Artificial Sequence
  Synthetic oligonucleotide
cgugcagcgcaaccacgagacggcc

SEQ ID NO: 15 - DNA, 25 bp, Artificial Sequence
  Synthetic oligonucleotide
gugcagcgcaaccacgagacggcct

SEQ ID NO: 16 - DNA, 25 bp, Artificial Sequence
  Synthetic oligonucleotide
ugcagcgcaaccacgagacggcctt

SEQ ID NO: 17 - DNA, 25 bp, Artificial Sequence
  Synthetic oligonucleotide
gcagcgcaaccacgagacggccutc

SEQ ID NO: 18 - DNA, 25 bp, Artificial Sequence
  Synthetic oligonucleotide
cagcgcaaccacgagacggccuucc

SEQ ID NO: 19 - DNA, 25 bp, Artificial Sequence
  Synthetic oligonucleotide
agcgcaaccacgagacggccuucca

SEQ ID NO: 20 - DNA, 25 bp, Artificial Sequence
  Synthetic oligonucleotide
gcgcaaccacgagacggccuuccaa

SEQ ID NO: 21 - DNA, 25 bp, Artificial Sequence
  Synthetic oligonucleotide
cgcaaccacgagacggccuuccaag

SEQ ID NO: 22 - DNA, 25 bp, Artificial Sequence
  Synthetic oligonucleotide
gcaaccacgagacggccuuccaagg

SEQ ID NO: 23 - DNA, 25 bp, Artificial Sequence
  Synthetic oligonucleotide
caaccacgagacggccuuccaaggc

SEQ ID NO: 24 - DNA, 25 bp, Artificial Sequence
  Synthetic oligonucleotide
aaccacgagacggccuuccaaggca

SEQ ID NO: 25 - DNA, 25 bp, Artificial Sequence
  Synthetic oligonucleotide
accacgagacggccuuccaaggcat

SEQ ID NO: 26 - DNA, 25 bp, Artificial Sequence
  Synthetic oligonucleotide
ccaaggcaugcuucggaaacuggac

SEQ ID NO: 27 - DNA, 25 bp, Artificial Sequence
  Synthetic oligonucleotide
caaggcaugcuucggaaacuggaca

SEQ ID NO: 28 - DNA, 25 bp, Artificial Sequence
  Synthetic oligonucleotide
cgaagacgaugugaaaucguuguct

SEQ ID NO: 29 - DNA, 25 bp, Artificial Sequence
  Synthetic oligonucleotide
cgaugugaaaucguugucucgagtg

SEQ ID NO: 30 - DNA, 25 bp, Artificial Sequence
  Synthetic oligonucleotide
gcaggauugugacucucauuucutt

SEQ ID NO: 31 - DNA, 25 bp, Artificial Sequence
  Synthetic oligonucleotide
gugacucucauuucuuuuggugcct

SEQ ID NO: 32 - DNA, 25 bp, Artificial Sequence
  Synthetic oligonucleotide
cuuuguggcuaaacacuugaagacc

SEQ ID NO: 33 - DNA, 25 bp, Artificial Sequence
  Synthetic oligonucleotide
uggcuaaacacuugaagaccauaaa

SEQ ID NO: 34 - DNA, 25 bp, Artificial Sequence
  Synthetic oligonucleotide
ggcuaaacacuugaagaccauaaac

SEQ ID NO: 35 - DNA, 25 bp, Artificial Sequence
  Synthetic oligonucleotide
gcuaaacacuugaagaccauaaacc

SEQ ID NO: 36 - DNA, 25 bp, Artificial Sequence
  Synthetic oligonucleotide
cuaaacacuugaagaccauaaacca

SEQ ID NO: 37 - DNA, 25 bp, Artificial Sequence
  Synthetic oligonucleotide
acuugaagaccauaaaccaagaaag

SEQ ID NO: 38 - DNA, 25 bp, Artificial Sequence
  Synthetic oligonucleotide
cuugaagaccauaaaccaagaaagc

SEQ ID NO: 39 - DNA, 25 bp, Artificial Sequence
  Synthetic oligonucleotide
agaccauaaaccaagaaagcugcat

SEQ ID NO: 40 - DNA, 25 bp, Artificial Sequence
  Synthetic oligonucleotide
caucgaaccauuagcagaaaguatc

SEQ ID NO: 41 - DNA, 25 bp, Artificial Sequence
  Synthetic oligonucleotide
aucgaaccauuagcagaaaguauca

SEQ ID NO: 42 - DNA, 25 bp, Artificial Sequence
  Synthetic oligonucleotide
accauuagcagaaaguaucacagac

SEQ ID NO: 43 - DNA, 25 bp, Artificial Sequence
  Synthetic oligonucleotide
gggacuggcuaguuaaacaaagagg

SEQ ID NO: 44 - DNA, 25 bp, Artificial Sequence
  Synthetic oligonucleotide
ggacuggcuaguuaaacaaagaggc

SEQ ID NO: 45 - DNA, 25 bp, Artificial Sequence
  Synthetic oligonucleotide
cuaguuaaacaaagaggcugggatg

SEQ ID NO: 46 - DNA, 25 bp, Artificial Sequence
  Synthetic oligonucleotide
aaacaaagaggcugggauggguutg

SEQ ID NO: 47 - DNA, 25 bp, Artificial Sequence
  Synthetic oligonucleotide
aacaaagaggcugggauggguuugt

SEQ ID NO: 48 - DNA, 25 bp, Artificial Sequence
  Synthetic oligonucleotide
acaaagaggcugggauggguuugtg

SEQ ID NO: 49 - DNA, 25 bp, Artificial Sequence
  Synthetic oligonucleotide
caaagaggcugggauggguuugugg

SEQ ID NO: 50 - DNA, 25 bp, Artificial Sequence
  Synthetic oligonucleotide
aaagaggcugggauggguuugugga

SEQ ID NO: 51 - DNA, 25 bp, Artificial Sequence
  Synthetic oligonucleotide
aagaggcugggauggguuuguggag

SEQ ID NO: 52 - DNA, 25 bp, Artificial Sequence
  Synthetic oligonucleotide
agaggcugggauggguuuguggagt

SEQ ID NO: 53 - DNA, 25 bp, Artificial Sequence
  Synthetic oligonucleotide
gaggcugggauggguuuguggagtt

SEQ ID NO: 54 - DNA, 25 bp, Artificial Sequence
  Synthetic oligonucleotide
aggcugggauggguuuguggagutc

SEQ ID NO: 55 - DNA, 25 bp, Artificial Sequence
  Synthetic oligonucleotide
ggcugggauggguuuguggaguuct

SEQ ID NO: 56 - DNA, 25 bp, Artificial Sequence
  Synthetic oligonucleotide
gcugggauggguuuguggaguuctt

SEQ ID NO: 57 - DNA, 25 bp, Artificial Sequence
  Synthetic oligonucleotide
cugggauggguuuguggaguucutc

SEQ ID NO: 58 - DNA, 25 bp, Artificial Sequence
  Synthetic oligonucleotide
ugggauggguuuguggaguucuucc

SEQ ID NO: 59 - DNA, 25 bp, Artificial Sequence
  Synthetic oligonucleotide
gggauggguuuguggaguucuucca

SEQ ID NO: 60 - DNA, 25 bp, Artificial Sequence
  Synthetic oligonucleotide
ggauggguuuguggaguucuuccat

SEQ ID NO: 61 - DNA, 25 bp, Artificial Sequence
  Synthetic oligonucleotide
gauggguuuguggaguucuuccatg

SEQ ID NO: 62 - DNA, 25 bp, Artificial Sequence
  Synthetic oligonucleotide
auggguuuguggaguucuuccaugt

SEQ ID NO: 63 - DNA, 25 bp, Artificial Sequence
  Synthetic oligonucleotide
uggguuuguggaguucuuccaugta

SEQ ID NO: 64 - DNA, 25 bp, Artificial Sequence
  Synthetic oligonucleotide
ggguuuguggaguucuuccauguag

SEQ ID NO: 65 - DNA, 25 bp, Artificial Sequence
  Synthetic oligonucleotide
gguuuguggaguucuuccauguaga

SEQ ID NO: 66 - DNA, 25 bp, Artificial Sequence
  Synthetic oligonucleotide
aguucuuccauguagaggaccuaga

SEQ ID NO: 67 - DNA, 25 bp, Artificial Sequence
  Synthetic oligonucleotide
ccauguagaggaccuagaagguggc

SEQ ID NO: 68 - DNA, 25 bp, Artificial Sequence
  Synthetic oligonucleotide
ggaccuagaagguggcaucaggaat

SEQ ID NO: 69 - DNA, 25 bp, Artificial Sequence
  Synthetic oligonucleotide
gguguugcuggaguaggagcuggtt

SEQ ID NO: 70 - DNA, 25 bp, Artificial Sequence
  Synthetic oligonucleotide
cugguuuggcauaucuaauaagata

SEQ ID NO: 71 - DNA, 25 bp, Artificial Sequence
  Synthetic oligonucleotide
uggcauaucuaauaagauagccuta

SEQ ID NO: 72 - DNA, 25 bp, Artificial Sequence
  Synthetic oligonucleotide
ggcauaucuaauaagauagccuuac

SEQ ID NO: 73 - DNA, 25 bp, Artificial Sequence
  Synthetic oligonucleotide
gcauaucuaauaagauagccuuact

SEQ ID NO: 74 - DNA, 25 bp, Artificial Sequence
  Synthetic oligonucleotide
cauaucuaauaagauagccuuactg

SEQ ID NO: 75 - DNA, 25 bp, Artificial Sequence
  Synthetic oligonucleotide
auaucuaauaagauagccuuacugt

SEQ ID NO: 76 - DNA, 25 bp, Artificial Sequence
  Synthetic oligonucleotide
uaucuaauaagauagccuuacugta

SEQ ID NO: 77 - DNA, 25 bp, Artificial Sequence
  Synthetic oligonucleotide
gccuuacuguaagugcaauaguuga

SEQ ID NO: 78 - DNA, 25 bp, Artificial Sequence
  Synthetic oligonucleotide
ggacuccaagcuguaacuuccuaga

SEQ ID NO: 79 - DNA, 25 bp, Artificial Sequence
  Synthetic oligonucleotide
uuccuagaguugcacccuagcaacc

SEQ ID NO: 80 - DNA, 25 bp, Artificial Sequence
  Synthetic oligonucleotide
gcaaguggcaagaggauuauggcta

SEQ ID NO: 81 - DNA, 25 bp, Artificial Sequence
  Synthetic oligonucleotide
uggcaagaggauuauggcuaacaag

SEQ ID NO: 82 - DNA, 25 bp, Artificial Sequence
  Synthetic oligonucleotide
ggcaagaggauuauggcuaacaaga

SEQ ID NO: 83 - DNA, 25 bp, Artificial Sequence
  Synthetic oligonucleotide
gaggauuauggcuaacaagaauaaa

SEQ ID NO: 84 - DNA, 25 bp, Artificial Sequence
  Synthetic oligonucleotide
uggcuaacaagaauaaauacauggg

SEQ ID NO: 85 - DNA, 25 bp, Artificial Sequence
  Synthetic oligonucleotide
ggcuaacaagaauaaauacauggga

SEQ ID NO: 86 - DNA, 25 bp, Artificial Sequence
  Synthetic oligonucleotide
gcuaacaagaauaaauacaugggaa

SEQ ID NO: 87 - DNA, 25 bp, Artificial Sequence
  Synthetic oligonucleotide
cuaacaagaauaaauacaugggaag

SEQ ID NO: 88 - DNA, 25 bp, Artificial Sequence
  Synthetic oligonucleotide
uaacaagaauaaauacaugggaaga

SEQ ID NO: 89 - DNA, 25 bp, Artificial Sequence
  Synthetic oligonucleotide
aacaagaauaaauacaugggaagag

SEQ ID NO: 90 - DNA, 25 bp, Artificial Sequence
  Synthetic oligonucleotide
acaagaauaaauacaugggaagagt

SEQ ID NO: 91 - DNA, 25 bp, Artificial Sequence
  Synthetic oligonucleotide
caagaauaaauacaugggaagagtg

SEQ ID NO: 92 - DNA, 25 bp, Artificial Sequence
  Synthetic oligonucleotide
aagaauaaauacaugggaagagugc

SEQ ID NO: 93 - DNA, 25 bp, Artificial Sequence
  Synthetic oligonucleotide
agaauaaauacaugggaagagugct

SEQ ID NO: 94 - DNA, 25 bp, Artificial Sequence
  Synthetic oligonucleotide
cauugauugaagagucacugucuga

SEQ ID NO: 95 - DNA, 25 bp, Artificial Sequence
  Synthetic oligonucleotide
cugucugaaagaagcaaaguucagt

SEQ ID NO: 96 - DNA, 25 bp, Artificial Sequence
  Synthetic oligonucleotide
acaaacuuuguuugggaagcuaugg

SEQ ID NO: 97 - DNA, 25 bp, Artificial Sequence
  Synthetic oligonucleotide
aggacuuuuagauuuagugaagatg

SEQ ID NO: 98 - DNA, 25 bp, Artificial Sequence
  Synthetic oligonucleotide
agaugguaggguggaaagacuuaat

SEQ ID NO: 99 - DNA, 25 bp, Artificial Sequence
  Synthetic oligonucleotide
cuuguugagaacaggaaaguggcca

SEQ ID NO: 100 - DNA, 25 bp, Artificial Sequence
  Synthetic oligonucleotide
gccaggcaagucauagaauugauta

SEQ ID NO: 101 - DNA, 25 bp, Artificial Sequence
  Synthetic oligonucleotide
aggcaagucauagaauugauuaccc

SEQ ID NO: 102 - DNA, 25 bp, Artificial Sequence
  Synthetic oligonucleotide
ggcaagucauagaauugauuacccg

SEQ ID NO: 103 - DNA, 25 bp, Artificial Sequence
  Synthetic oligonucleotide
cccgccgaauucauuaauuuacugt

SEQ ID NO: 104 - DNA, 25 bp, Artificial Sequence
  Synthetic oligonucleotide
cgaauucauuaauuuacuguagugt

SEQ ID NO: 105 - DNA, 25 bp, Artificial Sequence
  Synthetic oligonucleotide
guguuaagagaagcacuaagaaugc

SEQ ID NO: 106 - DNA, 25 bp, Artificial Sequence
  Synthetic oligonucleotide
agcacuaagaaugccagugaccugt

SEQ ID NO: 107 - DNA, 25 bp, Artificial Sequence
  Synthetic oligonucleotide
aaguaauagaacuaugacuguaagc

SEQ ID NO: 108 - DNA, 25 bp, Artificial Sequence
  Synthetic oligonucleotide
guaauagaacuaugacuguaagcct

SEQ ID NO: 109 - DNA, 25 bp, Artificial Sequence
  Synthetic oligonucleotide
cucaguacuguacaagggaagcutt

SEQ ID NO: 110 - DNA, 25 bp, Artificial Sequence
  Synthetic oligonucleotide
ccaguauacuucuuagaaaguccaa

SEQ ID NO: 111 - DNA, 25 bp, Artificial Sequence
  Synthetic oligonucleotide
ccuguuauacuuuggcuugguuucc

SEQ ID NO: 112 - DNA, 25 bp, Artificial Sequence
  Synthetic oligonucleotide
ccuaguuuaucaccaauaauacutg

SEQ ID NO: 113 - DNA, 25 bp, Artificial Sequence
  Synthetic oligonucleotide
caccaauaauacuugacggaaggct

SEQ ID NO: 114 - DNA, 25 bp, Artificial Sequence
  Synthetic oligonucleotide
accaauaauacuugacggaaggctc

SEQ ID NO: 115 - DNA, 25 bp, Artificial Sequence
  Synthetic oligonucleotide
ccaauaauacuugacggaaggcuca

SEQ ID NO: 116 - DNA, 25 bp, Artificial Sequence
  Synthetic oligonucleotide
ggcucaguaauuaguuaugaauatg

SEQ ID NO: 117 - DNA, 25 bp, Artificial Sequence
  Synthetic oligonucleotide
caguaauuaguuaugaauauggata

SEQ ID NO: 118 - DNA, 25 bp, Artificial Sequence
  Synthetic oligonucleotide
ucuuaagacagcuuguaaauguatt

SEQ ID NO: 119 - DNA, 25 bp, Artificial Sequence
  Synthetic oligonucleotide
uaaaaauuguauauauuuuuacaga

SEQ ID NO: 120 - DNA, 25 bp, Artificial Sequence
  Synthetic oligonucleotide
uacagaaagucuauuucuuugaaac

SEQ ID NO: 121 - DNA, 25 bp, Artificial Sequence
  Synthetic oligonucleotide
acagaaagucuauuucuuugaaacg

SEQ ID NO: 122 - DNA, 25 bp, Artificial Sequence
  Synthetic oligonucleotide
cagaaagucuauuucuuugaaacga

SEQ ID NO: 123 - DNA, 25 bp, Artificial Sequence
  Synthetic oligonucleotide
agaaagucuauuucuuugaaacgaa

SEQ ID NO: 124 - DNA, 25 bp, Artificial Sequence
  Synthetic oligonucleotide
gaaagucuauuucuuugaaacgaag

SEQ ID NO: 125 - DNA, 25 bp, Artificial Sequence
  Synthetic oligonucleotide
cgaaggaaguaucgaauuuacauta

SEQ ID NO: 126 - DNA, 25 bp, Artificial Sequence
  Synthetic oligonucleotide
cgaauuuacauuaguuuuuuucata

SEQ ID NO: 127 - DNA, 25 bp, Artificial Sequence
  Synthetic oligonucleotide
acuuugcaacuuccguaauuaggaa

SEQ ID NO: 128 - DNA, 25 bp, Artificial Sequence
  Synthetic oligonucleotide
aguguauacagaacgaauugaugtg

SEQ ID NO: 129 - DNA, 25 bp, Artificial Sequence
  Synthetic oligonucleotide
ggaacaaaucugauaacuaugcagg

SEQ ID NO: 130 - DNA, 25 bp, Artificial Sequence
  Synthetic oligonucleotide
auuuucuuaucugauuuugguaagt

SEQ ID NO: 131 - DNA, 25 bp, Artificial Sequence
  Synthetic oligonucleotide
gguuuuucuuugaaaaccugggatt

SEQ ID NO: 132 - DNA, 25 bp, Artificial Sequence
  Synthetic oligonucleotide
gggauugagagguugaugaauggaa

SEQ ID NO: 133 - DNA, 25 bp, Artificial Sequence
  Synthetic oligonucleotide
agagguugaugaauggaaauucutt

SEQ ID NO: 134 - DNA, 25 bp, Artificial Sequence
  Synthetic oligonucleotide
guugaugaauggaaauucuuucact

SEQ ID NO: 135 - DNA, 25 bp, Artificial Sequence
  Synthetic oligonucleotide
uaugcaaguuuucaauaauuaggtc

SEQ ID NO: 136 - DNA, 25 bp, Artificial Sequence
  Synthetic oligonucleotide
gguuacugaugacuuacaaauaatg

SEQ ID NO: 137 - DNA, 25 bp, Artificial Sequence
  Synthetic oligonucleotide
ugggcaauacucauuugaguucctt

SEQ ID NO: 138 - DNA, 25 bp, Artificial Sequence
  Synthetic oligonucleotide
ccauuugaccuaauuuaacugguga

SEQ ID NO: 139 - DNA, 25 bp, Artificial Sequence
  Synthetic oligonucleotide
aaagcuuuuacuaaaagauuuucag

SEQ ID NO: 140 - DNA, 25 bp, Artificial Sequence
  Synthetic oligonucleotide
gguggauggagagacauuugauccc

SEQ ID NO: 141 - DNA, 25 bp, Artificial Sequence
  Synthetic oligonucleotide
cuuaauaaauuauaaaaugauggct

SEQ ID NO: 142 - DNA, 25 bp, Artificial Sequence
  Synthetic oligonucleotide
accauggugcuauuauuaggcuugc

SEQ ID NO: 143 - DNA, 25 bp, Artificial Sequence
  Synthetic oligonucleotide
agccuaguaugucaauaaagcaaat

SEQ ID NO: 144 - DNA, 25 bp, Artificial Sequence
  Synthetic oligonucleotide
cuguuuuguuucuauuaaugauucc

SEQ ID NO: 145 - DNA, 25 bp, Artificial Sequence
  Synthetic oligonucleotide
cuauuaaugauucccaaaccuugtt

SEQ ID NO: 146 - DNA, 25 bp, Artificial Sequence
  Synthetic oligonucleotide
uguugcaaguuuuugcauuggcatc

SEQ ID NO: 147 - DNA, 25 bp, Artificial Sequence
  Synthetic oligonucleotide
ggauuucagucuugauguuuguuct

SEQ ID NO: 148 - DNA, 25 bp, Artificial Sequence
  Synthetic oligonucleotide
uccuugaaauugcugauuguucugc

SEQ ID NO: 149 - DNA, 25 bp, Artificial Sequence
  Synthetic oligonucleotide
ucccucuacagauauuuauaucaat

SEQ ID NO: 150 - DNA, 25 bp, Artificial Sequence
  Synthetic oligonucleotide
accaagaguccacagaccuuucatc

SEQ ID NO: 151 - DNA, 25 bp, Artificial Sequence
  Synthetic oligonucleotide
ccaagaguccacagaccuuucauct

SEQ ID NO: 152 - DNA, 25 bp, Artificial Sequence
  Synthetic oligonucleotide
guccacagaccuuucaucuuucacg

SEQ ID NO: 153 - DNA, 25 bp, Artificial Sequence
  Synthetic oligonucleotide
uccacagaccuuucaucuuucacga

SEQ ID NO: 154 - DNA, 25 bp, Artificial Sequence
  Synthetic oligonucleotide
ccacagaccuuucaucuuucacgaa

SEQ ID NO: 155 - DNA, 25 bp, Artificial Sequence
  Synthetic oligonucleotide
cacagaccuuucaucuuucacgaac

SEQ ID NO: 156 - DNA, 25 bp, Artificial Sequence
  Synthetic oligonucleotide
agaccuuucaucuuucacgaacutg

SEQ ID NO: 157 - DNA, 25 bp, Artificial Sequence
  Synthetic oligonucleotide
ccuuucaucuuucacgaacuugatc

SEQ ID NO: 158 - DNA, 25 bp, Artificial Sequence
  Synthetic oligonucleotide
gugacacuaacagucauugagaggt

SEQ ID NO: 159 - DNA, 25 bp, Artificial Sequence
  Synthetic oligonucleotide
cuaacagucauugagaggugggagg

SEQ ID NO: 160 - DNA, 25 bp, Artificial Sequence
  Synthetic oligonucleotide
ggaguaugcucacuuaaauuuacag

SEQ ID NO: 161 - DNA, 25 bp, Artificial Sequence
  Synthetic oligonucleotide
ucacuuaaauuuacagaaagaggtg

SEQ ID NO: 162 - DNA, 25 bp, Artificial Sequence
  Synthetic oligonucleotide
cuuaaauuuacagaaagaggugagc

SEQ ID NO: 163 - DNA, 25 bp, Artificial Sequence
  Synthetic oligonucleotide
acugaagaaagugucuauauuggaa

SEQ ID NO: 164 - DNA, 25 bp, Artificial Sequence
  Synthetic oligonucleotide
ggaacuagggucauuugaaagcutc

SEQ ID NO: 165 - DNA, 25 bp, Artificial Sequence
  Synthetic oligonucleotide
cuagggucauuugaaagcuucagtc

SEQ ID NO: 166 - DNA, 25 bp, Artificial Sequence
  Synthetic oligonucleotide
uagggucauuugaaagcuucaguct

SEQ ID NO: 167 - DNA, 25 bp, Artificial Sequence
  Synthetic oligonucleotide
agggucauuugaaagcuucaguctc

SEQ ID NO: 168 - DNA, 25 bp, Artificial Sequence
  Synthetic oligonucleotide
gggucauuugaaagcuucagucucg

SEQ ID NO: 169 - DNA, 25 bp, Artificial Sequence
  Synthetic oligonucleotide
ggucauuugaaagcuucagucucgg

SEQ ID NO: 170 - DNA, 25 bp, Artificial Sequence
  Synthetic oligonucleotide
agucucggaacaugaccuuuaguct

SEQ ID NO: 171 - DNA, 25 bp, Artificial Sequence
  Synthetic oligonucleotide
gaacaugaccuuuagucuguggact

SEQ ID NO: 172 - DNA, 25 bp, Artificial Sequence
  Synthetic oligonucleotide
acaugaccuuuagucuguggacucc

SEQ ID NO: 173 - DNA, 25 bp, Artificial Sequence
  Synthetic oligonucleotide
cauuuaaaaauagguaugaauaaga

SEQ ID NO: 174 - DNA, 25 bp, Artificial Sequence
  Synthetic oligonucleotide
gguaugaauaagaugacuaagaatg

SEQ ID NO: 175 - DNA, 25 bp, Artificial Sequence
  Synthetic oligonucleotide
gcccaucucagagccauaaggucat

SEQ ID NO: 176 - DNA, 25 bp, Artificial Sequence
  Synthetic oligonucleotide
accuauguauuuaucguucuugatc

SEQ ID NO: 177 - DNA, 25 bp, Artificial Sequence
  Synthetic oligonucleotide
gccgcuuauuuauaucauguauctc

SEQ ID NO: 178 - DNA, 25 bp, Artificial Sequence
  Synthetic oligonucleotide
guaguuuuuaauuaaucuuaagatc

SEQ ID NO: 179 - DNA, 25 bp, Artificial Sequence
  Synthetic oligonucleotide
ccugucugccaaauccaguggaaac

SEQ ID NO: 180 - DNA, 25 bp, Artificial Sequence
  Synthetic oligonucleotide
ugccaaauccaguggaaacaagugc

SEQ ID NO: 181 - DNA, 25 bp, Artificial Sequence
  Synthetic oligonucleotide
aguggaaacaagugcauagauguga

SEQ ID NO: 182 - DNA, 25 bp, Artificial Sequence
  Synthetic oligonucleotide
ggaaacaagugcauagaugugaatt

SEQ ID NO: 183 - DNA, 25 bp, Artificial Sequence
  Synthetic oligonucleotide
acuucccaauucauuagguaugact

SEQ ID NO: 184 - DNA, 25 bp, Artificial Sequence
  Synthetic oligonucleotide
gguaugacuguggaaauacagacaa

SEQ ID NO: 185 - DNA, 25 bp, Artificial Sequence
  Synthetic oligonucleotide
gacuguggaaauacagacaaggatc

SEQ ID NO: 186 - DNA, 25 bp, Artificial Sequence
  Synthetic oligonucleotide
acuguggaaauacagacaaggauct

SEQ ID NO: 187 - DNA, 25 bp, Artificial Sequence
  Synthetic oligonucleotide
uguggaaauacagacaaggaucuta

SEQ ID NO: 188 - DNA, 25 bp, Artificial Sequence
  Synthetic oligonucleotide
guggaaauacagacaaggaucuuag

SEQ ID NO: 189 - DNA, 25 bp, Artificial Sequence
  Synthetic oligonucleotide
uggaaauacagacaaggaucuuagt

SEQ ID NO: 190 - DNA, 25 bp, Artificial Sequence
  Synthetic oligonucleotide
ggaaauacagacaaggaucuuagtt

SEQ ID NO: 191 - DNA, 25 bp, Artificial Sequence
  Synthetic oligonucleotide
gaaauacagacaaggaucuuagutg

SEQ ID NO: 192 - DNA, 25 bp, Artificial Sequence
  Synthetic oligonucleotide
ggaggaggcagguggucuaagugct

SEQ ID NO: 193 - DNA, 25 bp, Artificial Sequence
  Synthetic oligonucleotide
gcuacguaguucgggcaaauccucc

SEQ ID NO: 194 - DNA, 25 bp, Artificial Sequence
  Synthetic oligonucleotide
aggauuugcuuagaaggauggcgct

SEQ ID NO: 195 - DNA, 25 bp, Artificial Sequence
  Synthetic oligonucleotide
ggauuugcuuagaaggauggcgctc

SEQ ID NO: 196 - DNA, 25 bp, Artificial Sequence
  Synthetic oligonucleotide
ccucuaguguuucauguacauuctg

SEQ ID NO: 197 - DNA, 25 bp, Artificial Sequence
  Synthetic oligonucleotide
acaccuugguucugguuaaacagct

SEQ ID NO: 198 - DNA, 25 bp, Artificial Sequence
  Synthetic oligonucleotide
agcugugccaggaaggguuaggacc

SEQ ID NO: 199 - DNA, 25 bp, Artificial Sequence
  Synthetic oligonucleotide
aggaaggguuaggaccaacuacaaa

SEQ ID NO: 200 - DNA, 25 bp, Artificial Sequence
  Synthetic oligonucleotide
gguuaggaccaacuacaaauuaatg

SEQ ID NO: 201 - DNA, 25 bp, Artificial Sequence
  Synthetic oligonucleotide
ggaacggccuuccucacuccugact

SEQ ID NO: 202 - DNA, 25 bp, Artificial Sequence
  Synthetic oligonucleotide
gcggagaaacgcggucaucggcutg

SEQ ID NO: 203 - DNA, 25 bp, Artificial Sequence
  Synthetic oligonucleotide
ggaggaggaacuggacggcugcgag

SEQ ID NO: 204 - DNA, 25 bp, Artificial Sequence
  Synthetic oligonucleotide
aggaggaagaggacgaccuauaccg

SEQ ID NO: 205 - DNA, 25 bp, Artificial Sequence
  Synthetic oligonucleotide
ggaggaagaggacgaccuauaccgc

SEQ ID NO: 206 - DNA, 25 bp, Artificial Sequence
  Synthetic oligonucleotide
gaggaagaggacgaccuauaccgcc

SEQ ID NO: 207 - DNA, 25 bp, Artificial Sequence
  Synthetic oligonucleotide
ggaagaggacgaccuauaccgccag

SEQ ID NO: 208 - DNA, 25 bp, Artificial Sequence
  Synthetic oligonucleotide
ggauugugacucuuauuucuuucgg

SEQ ID NO: 209 - DNA, 25 bp, Artificial Sequence
  Synthetic oligonucleotide
uggccaaacacuuaaagagcguaaa

SEQ ID NO: 210 - DNA, 25 bp, Artificial Sequence
  Synthetic oligonucleotide
ggccaaacacuuaaagagcguaaac

SEQ ID NO: 211 - DNA, 25 bp, Artificial Sequence
  Synthetic oligonucleotide
gccaaacacuuaaagagcguaaacc

SEQ ID NO: 212 - DNA, 25 bp, Artificial Sequence
  Synthetic oligonucleotide
agagcguaaaccaagaaagcuucat

SEQ ID NO: 213 - DNA, 25 bp, Artificial Sequence
  Synthetic oligonucleotide
aaccauuagcagaaacuaucacaga

SEQ ID NO: 214 - DNA, 25 bp, Artificial Sequence
  Synthetic oligonucleotide
agcagaaacuaucacagauguuctt

SEQ ID NO: 215 - DNA, 25 bp, Artificial Sequence
  Synthetic oligonucleotide
gggacuggcuugucaaacaaagagg

SEQ ID NO: 216 - DNA, 25 bp, Artificial Sequence
  Synthetic oligonucleotide
ggacuggcuugucaaacaaagaggc

SEQ ID NO: 217 - DNA, 25 bp, Artificial Sequence
  Synthetic oligonucleotide
guggaguucuuccacguacaggacc

SEQ ID NO: 218 - DNA, 25 bp, Artificial Sequence
  Synthetic oligonucleotide
aguucuuccacguacaggaccuaga

SEQ ID NO: 219 - DNA, 25 bp, Artificial Sequence
  Synthetic oligonucleotide
ccacguacaggaccuagaaggcggc

SEQ ID NO: 220 - DNA, 25 bp, Artificial Sequence
  Synthetic oligonucleotide
ggucuggcauaucuaauaagauagc

SEQ ID NO: 221 - DNA, 25 bp, Artificial Sequence
  Synthetic oligonucleotide
ccaccaaacuacaugcaucugugaa

SEQ ID NO: 222 - DNA, 25 bp, Artificial Sequence
  Synthetic oligonucleotide
uguguauuuaugaagguggacuuga

SEQ ID NO: 223 - DNA, 25 bp, Artificial Sequence
  Synthetic oligonucleotide
uguauuuaugaagguggacuugaag

SEQ ID NO: 224 - DNA, 25 bp, Artificial Sequence
  Synthetic oligonucleotide
auuuaugaagguggacuugaagctg

SEQ ID NO: 225 - DNA, 25 bp, Artificial Sequence
  Synthetic oligonucleotide
ccaguucuacuguagcaacauagca

SEQ ID NO: 226 - DNA, 25 bp, Artificial Sequence
  Synthetic oligonucleotide
cuggaagagucacugucugaaugaa

SEQ ID NO: 227 - DNA, 25 bp, Artificial Sequence
  Synthetic oligonucleotide
uggaagagucacugucugaaugaag

SEQ ID NO: 228 - DNA, 25 bp, Artificial Sequence
  Synthetic oligonucleotide
ggaagagucacugucugaaugaagc

SEQ ID NO: 229 - DNA, 25 bp, Artificial Sequence
  Synthetic oligonucleotide
cugucugaaugaagcaaaguuccct

SEQ ID NO: 230 - DNA, 25 bp, Artificial Sequence
  Synthetic oligonucleotide
cccucucagcaaacacugagaggcc

SEQ ID NO: 231 - DNA, 25 bp, Artificial Sequence
  Synthetic oligonucleotide
ccucucagcaaacacugagaggcca

SEQ ID NO: 232 - DNA, 25 bp, Artificial Sequence
  Synthetic oligonucleotide
agcaaacacugagaggccauggaga

SEQ ID NO: 233 - DNA, 25 bp, Artificial Sequence
  Synthetic oligonucleotide
cacugagaggccauggagaaggact

SEQ ID NO: 234 - DNA, 25 bp, Artificial Sequence
  Synthetic oligonucleotide
ggccauggagaaggacuucuagaat

SEQ ID NO: 235 - DNA, 25 bp, Artificial Sequence
  Synthetic oligonucleotide
gccauggagaaggacuucuagaatg

SEQ ID NO: 236 - DNA, 25 bp, Artificial Sequence
  Synthetic oligonucleotide
gagaaggacuucuagaaugaaugaa

SEQ ID NO: 237 - DNA, 25 bp, Artificial Sequence
  Synthetic oligonucleotide
aggacuucuagaaugaaugaaaggg

SEQ ID NO: 238 - DNA, 25 bp, Artificial Sequence
  Synthetic oligonucleotide
ggauggaaagguuugauuuccuatc

SEQ ID NO: 239 - DNA, 25 bp, Artificial Sequence
  Synthetic oligonucleotide
agucaucaggcuagucacaaagctc

SEQ ID NO: 240 - DNA, 25 bp, Artificial Sequence
  Synthetic oligonucleotide
gucaucaggcuagucacaaagcuca

SEQ ID NO: 241 - DNA, 25 bp, Artificial Sequence
  Synthetic oligonucleotide
gcuagucacaaagcucaauaaauat

SEQ ID NO: 242 - DNA, 25 bp, Artificial Sequence
  Synthetic oligonucleotide
gcccuaauuaacaacguuggugact

SEQ ID NO: 243 - DNA, 25 bp, Artificial Sequence
  Synthetic oligonucleotide
ccuacaagucaccaaacgaugacta

SEQ ID NO: 244 - DNA, 25 bp, Artificial Sequence
  Synthetic oligonucleotide
cuacaagucaccaaacgaugacuag

SEQ ID NO: 245 - DNA, 25 bp, Artificial Sequence
  Synthetic oligonucleotide
ucaccaaacgaugacuagaagcugc

SEQ ID NO: 246 - DNA, 25 bp, Artificial Sequence
  Synthetic oligonucleotide
caccaaacgaugacuagaagcugca

SEQ ID NO: 247 - DNA, 25 bp, Artificial Sequence
  Synthetic oligonucleotide
accaaacgaugacuagaagcugcag

SEQ ID NO: 248 - DNA, 25 bp, Artificial Sequence
  Synthetic oligonucleotide
ccaaacgaugacuagaagcugcagt

SEQ ID NO: 249 - DNA, 25 bp, Artificial Sequence
  Synthetic oligonucleotide
ggaaugugaagggaggccucugagc

SEQ ID NO: 250 - DNA, 25 bp, Artificial Sequence
  Synthetic oligonucleotide
ugcuugacaaagucccaagugcuca

SEQ ID NO: 251 - DNA, 25 bp, Artificial Sequence
  Synthetic oligonucleotide
gcuugacaaagucccaagugcucag

SEQ ID NO: 252 - DNA, 25 bp, Artificial Sequence
  Synthetic oligonucleotide
gacaaagucccaagugcucaggact

SEQ ID NO: 253 - DNA, 25 bp, Artificial Sequence
  Synthetic oligonucleotide
cccugucuacuuuggcuugguuugg

SEQ ID NO: 254 - DNA, 25 bp, Artificial Sequence
  Synthetic oligonucleotide
cuuaaguuuauuagccuagugaugg

SEQ ID NO: 255 - DNA, 25 bp, Artificial Sequence
  Synthetic oligonucleotide
aguacuugacuuaagguucacuaat

SEQ ID NO: 256 - DNA, 25 bp, Artificial Sequence
  Synthetic oligonucleotide
acauaagagggaagucuuggauuta

SEQ ID NO: 257 - DNA, 25 bp, Artificial Sequence
  Synthetic oligonucleotide
gcuucucuaguuagaaauguauutc

SEQ ID NO: 258 - DNA, 25 bp, Artificial Sequence
  Synthetic oligonucleotide
ucauccguucuaguguauaugcaga

SEQ ID NO: 259 - DNA, 25 bp, Artificial Sequence
  Synthetic oligonucleotide
uguguggacugguuauagauuuata

SEQ ID NO: 260 - DNA, 25 bp, Artificial Sequence
  Synthetic oligonucleotide
acuaugcaggguuaauuauccaatc

SEQ ID NO: 261 - DNA, 25 bp, Artificial Sequence
  Synthetic oligonucleotide
cacagguagauagauguaagacatt

SEQ ID NO: 262 - DNA, 25 bp, Artificial Sequence
  Synthetic oligonucleotide
guagauagauguaagacauuugatc

SEQ ID NO: 263 - DNA, 25 bp, Artificial Sequence
  Synthetic oligonucleotide
aaaugguaaagcaggcuagaguctt

SEQ ID NO: 264 - DNA, 25 bp, Artificial Sequence
  Synthetic oligonucleotide
ggugcuauucacuggguuuacuugt

SEQ ID NO: 265 - DNA, 25 bp, Artificial Sequence
  Synthetic oligonucleotide
ucuugucuacuaaggauugccaagc

SEQ ID NO: 266 - DNA, 25 bp, Artificial Sequence
  Synthetic oligonucleotide
gucucuagguguagccuuuacuucc

SEQ ID NO: 267 - DNA, 25 bp, Artificial Sequence
  Synthetic oligonucleotide
cuauagagucgucuacacuuccucc

SEQ ID NO: 268 - DNA, 25 bp, Artificial Sequence
  Synthetic oligonucleotide
cgucuacacuuccucccugugcuct

SEQ ID NO: 269 - DNA, 25 bp, Artificial Sequence
  Synthetic oligonucleotide
guuaucugcauuagaacucucaccc

SEQ ID NO: 270 - DNA, 25 bp, Artificial Sequence
  Synthetic oligonucleotide
ccuaaucagagucagcacagcuutc

SEQ ID NO: 271 - DNA, 25 bp, Artificial Sequence
  Synthetic oligonucleotide
agcuuuccugucagaggauaggaac

SEQ ID NO: 272 - DNA, 25 bp, Artificial Sequence
  Synthetic oligonucleotide
ccugucagaggauaggaacacuugc

SEQ ID NO: 273 - DNA, 25 bp, Artificial Sequence
  Synthetic oligonucleotide
gucagaggauaggaacacuugcuct

SEQ ID NO: 274 - DNA, 25 bp, Artificial Sequence
  Synthetic oligonucleotide
ucagaggauaggaacacuugcuctt

SEQ ID NO: 275 - DNA, 25 bp, Artificial Sequence
  Synthetic oligonucleotide
ccgacagugaccagggauuggcatt

SEQ ID NO: 276 - DNA, 25 bp, Artificial Sequence
  Synthetic oligonucleotide
ugcuuuccauuguuacuuugucuat

SEQ ID NO: 277 - DNA, 25 bp, Artificial Sequence
  Synthetic oligonucleotide
gguuggaaauuauacguuuauactt

SEQ ID NO: 278 - DNA, 25 bp, Artificial Sequence
  Synthetic oligonucleotide
auuaguuugcuccaaguaugacugt

SEQ ID NO: 279 - DNA, 25 bp, Artificial Sequence
  Synthetic oligonucleotide
cacuuaaguuuagagaaacacuggg

SEQ ID NO: 280 - DNA, 25 bp, Artificial Sequence
  Synthetic oligonucleotide
acugguaacugaagguauuuaagct

SEQ ID NO: 281 - DNA, 25 bp, Artificial Sequence
  Synthetic oligonucleotide
gccucagaaugugaccuuuagucag

SEQ ID NO: 282 - DNA, 25 bp, Artificial Sequence
  Synthetic oligonucleotide
uaggcaggaaucaaaugacuaagaa

SEQ ID NO: 283 - DNA, 25 bp, Artificial Sequence
  Synthetic oligonucleotide
aggcaggaaucaaaugacuaagaat

SEQ ID NO: 284 - DNA, 25 bp, Artificial Sequence
  Synthetic oligonucleotide
ggcaggaaucaaaugacuaagaatg

SEQ ID NO: 285 - DNA, 25 bp, Artificial Sequence
  Synthetic oligonucleotide
gcaggaaucaaaugacuaagaaugt

SEQ ID NO: 286 - DNA, 25 bp, Artificial Sequence
  Synthetic oligonucleotide
caggaaucaaaugacuaagaaugta

SEQ ID NO: 287 - DNA, 25 bp, Artificial Sequence
  Synthetic oligonucleotide
aggaaucaaaugacuaagaauguaa

SEQ ID NO: 288 - DNA, 25 bp, Artificial Sequence
  Synthetic oligonucleotide
ggaaucaaaugacuaagaauguaat

SEQ ID NO: 289 - DNA, 25 bp, Artificial Sequence
  Synthetic oligonucleotide
gaaucaaaugacuaagaauguaata

SEQ ID NO: 290 - DNA, 25 bp, Artificial Sequence
  Synthetic oligonucleotide
gacuaagaauguaauagggaagaag

SEQ ID NO: 291 - DNA, 25 bp, Artificial Sequence
  Synthetic oligonucleotide
gccagcuugggagugauuuguacct

SEQ ID NO: 292 - DNA, 25 bp, Artificial Sequence
  Synthetic oligonucleotide
ccuugaucauaguuugcuuauuuat

SEQ ID NO: 293 - DNA, 25 bp, Artificial Sequence
  Synthetic oligonucleotide
agcacuuuauguaguugaauaaacc

SEQ ID NO: 294 - DNA, 25 bp, Artificial Sequence
  Synthetic oligonucleotide
gcacuuuauguaguugaauaaaccc

SEQ ID NO: 295 - DNA, 25 bp, Artificial Sequence
  Synthetic oligonucleotide
uguuuacuaggagccugacuuccca

SEQ ID NO: 296 - DNA, 25 bp, Artificial Sequence
  Synthetic oligonucleotide
ccugacuucccagcucacaaagggt

SEQ ID NO: 297 - DNA, 25 bp, Artificial Sequence
  Synthetic oligonucleotide
cugacuucccagcucacaaagggtg

SEQ ID NO: 298 - DNA, 25 bp, Artificial Sequence
  Synthetic oligonucleotide
ugacuucccagcucacaaaggguga

SEQ ID NO: 299 - DNA, 25 bp, Artificial Sequence
  Synthetic oligonucleotide
ccagcucacaaagggugaaaugaaa

SEQ ID NO: 300 - DNA, 25 bp, Artificial Sequence
  Synthetic oligonucleotide
cucacaaagggugaaaugaaagctg

SEQ ID NO: 301 - DNA, 25 bp, Artificial Sequence
  Synthetic oligonucleotide
ugaaguacagacaggaucuuaguag

SEQ ID NO: 302 - DNA, 25 bp, Artificial Sequence
  Synthetic oligonucleotide
aguacagacaggaucuuaguaggta

SEQ ID NO: 303 - DNA, 25 bp, Artificial Sequence
  Synthetic oligonucleotide
gccaugaagacuuggagagcgcagt

SEQ ID NO: 304 - DNA, 25 bp, Artificial Sequence
  Synthetic oligonucleotide
uuggagggaagaagcaugugguctg

SEQ ID NO: 305 - DNA, 25 bp, Artificial Sequence
  Synthetic oligonucleotide
agugcugacuagaugaauaguugag

SEQ ID NO: 306 - DNA, 25 bp, Artificial Sequence
  Synthetic oligonucleotide
ugacuagaugaauaguugaggcaca

SEQ ID NO: 307 - DNA, 25 bp, Artificial Sequence
  Synthetic oligonucleotide
aggcacauccuucagagaagaggga

SEQ ID NO: 308 - DNA, 25 bp, Artificial Sequence
  Synthetic oligonucleotide
ggcacauccuucagagaagagggag

SEQ ID NO: 309 - DNA, 25 bp, Artificial Sequence
  Synthetic oligonucleotide
gcugcuuggaaagauggcucucagc

SEQ ID NO: 310 - DNA, 25 bp, Artificial Sequence
  Synthetic oligonucleotide
ucuguuugucuuacacgucucucag

SEQ ID NO: 311 - DNA, 25 bp, Artificial Sequence
  Synthetic oligonucleotide
agcaucuuccauguacauucuauct

SEQ ID NO: 312 - DNA, 25 bp, Artificial Sequence
  Synthetic oligonucleotide
gcaccuaacacuuuaacagcugutc

SEQ ID NO: 313 - DNA, 25 bp, Artificial Sequence
  Synthetic oligonucleotide
agcuguucccgaaaggguuaggacc

SEQ ID NO: 314 - DNA, 25 bp, Artificial Sequence
  Synthetic oligonucleotide
cgaaaggguuaggaccaacugcaag

SEQ ID NO: 315 - DNA, 25 bp, Artificial Sequence
  Synthetic oligonucleotide
ccaacugcaaguuaauguggguugt

SEQ ID NO: 316 - RNA, 27 nt, Artificial Sequence
  Synthetic oligonucleotide
gaaggaagcggaagugagaaguggcga

SEQ ID NO: 317 - RNA, 27 nt, Artificial Sequence
  Synthetic oligonucleotide
cuggaaggaagcggaagugagaagugg

SEQ ID NO: 318 - RNA, 27 nt, Artificial Sequence
  Synthetic oligonucleotide
aggccaaacauugccagucgccgccgc

SEQ ID NO: 319 - RNA, 27 nt, Artificial Sequence
  Synthetic oligonucleotide
guagagguugaguccgauuaccgcguu

SEQ ID NO: 320 - RNA, 27 nt, Artificial Sequence
  Synthetic oligonucleotide
cuucuccguagccaaaagucgcccucc

SEQ ID NO: 321 - RNA, 27 nt, Artificial Sequence
  Synthetic oligonucleotide
ugggcgcgaagaaaagcagccucgcgg

SEQ ID NO: 322 - RNA, 27 nt, Artificial Sequence
  Synthetic oligonucleotide
cccguccguacugguguuauuaccaga

SEQ ID NO: 323 - RNA, 27 nt, Artificial Sequence
  Synthetic oligonucleotide
cugccgguacaacucguccuccuccuc

SEQ ID NO: 324 - RNA, 27 nt, Artificial Sequence
  Synthetic oligonucleotide
gagagauaaucuccagcgacugccggu

SEQ ID NO: 325 - RNA, 27 nt, Artificial Sequence
  Synthetic oligonucleotide
ccugcccauuggcuuuguguccuuggc

SEQ ID NO: 326 - RNA, 27 nt, Artificial Sequence
  Synthetic oligonucleotide
cgucguaaggucuccagcgccuuccug

SEQ ID NO: 327 - RNA, 27 nt, Artificial Sequence
  Synthetic oligonucleotide
ccgucucgugguugcgcugcacgccau

SEQ ID NO: 328 - RNA, 27 nt, Artificial Sequence
  Synthetic oligonucleotide
gccgucucgugguugcgcugcacgcca

SEQ ID NO: 329 - RNA, 27 nt, Artificial Sequence
  Synthetic oligonucleotide
ggccgucucgugguugcgcugcacgcc

SEQ ID NO: 330 - RNA, 27 nt, Artificial Sequence
  Synthetic oligonucleotide
aggccgucucgugguugcgcugcacgc

SEQ ID NO: 331 - RNA, 27 nt, Artificial Sequence
  Synthetic oligonucleotide
aaggccgucucgugguugcgcugcacg

SEQ ID NO: 332 - RNA, 27 nt, Artificial Sequence
  Synthetic oligonucleotide
gaaggccgucucgugguugcgcugcac

SEQ ID NO: 333 - RNA, 27 nt, Artificial Sequence
  Synthetic oligonucleotide
ggaaggccgucucgugguugcgcugca

SEQ ID NO: 334 - RNA, 27 nt, Artificial Sequence
  Synthetic oligonucleotide
uggaaggccgucucgugguugcgcugc

SEQ ID NO: 335 - RNA, 27 nt, Artificial Sequence
  Synthetic oligonucleotide
uuggaaggccgucucgugguugcgcug

SEQ ID NO: 336 - RNA, 27 nt, Artificial Sequence
  Synthetic oligonucleotide
cuuggaaggccgucucgugguugcgcu

SEQ ID NO: 337 - RNA, 27 nt, Artificial Sequence
  Synthetic oligonucleotide
ccuuggaaggccgucucgugguugcgc

SEQ ID NO: 338 - RNA, 27 nt, Artificial Sequence
  Synthetic oligonucleotide
gccuuggaaggccgucucgugguugcg

SEQ ID NO: 339 - RNA, 27 nt, Artificial Sequence
  Synthetic oligonucleotide
ugccuuggaaggccgucucgugguugc

SEQ ID NO: 340 - RNA, 27 nt, Artificial Sequence
  Synthetic oligonucleotide
augccuuggaaggccgucucgugguug

SEQ ID NO: 341 - RNA, 27 nt, Artificial Sequence
  Synthetic oligonucleotide
guccaguuuccgaagcaugccuuggaa

SEQ ID NO: 342 - RNA, 27 nt, Artificial Sequence
  Synthetic oligonucleotide
uguccaguuuccgaagcaugccuugga

SEQ ID NO: 343 - RNA, 27 nt, Artificial Sequence
  Synthetic oligonucleotide
agacaacgauuucacaucgucuucguu

SEQ ID NO: 344 - RNA, 27 nt, Artificial Sequence
  Synthetic oligonucleotide
cacucgagacaacgauuucacaucguc

SEQ ID NO: 345 - RNA, 27 nt, Artificial Sequence
  Synthetic oligonucleotide
aaagaaaugagagucacaauccugccc

SEQ ID NO: 346 - RNA, 27 nt, Artificial Sequence
  Synthetic oligonucleotide
aggcaccaaaagaaaugagagucacaa

SEQ ID NO: 347 - RNA, 27 nt, Artificial Sequence
  Synthetic oligonucleotide
ggucuucaaguguuuagccacaaaggc

SEQ ID NO: 348 - RNA, 27 nt, Artificial Sequence
  Synthetic oligonucleotide
uuuauggucuucaaguguuuagccaca

SEQ ID NO: 349 - RNA, 27 nt, Artificial Sequence
  Synthetic oligonucleotide
guuuauggucuucaaguguuuagccac

SEQ ID NO: 350 - RNA, 27 nt, Artificial Sequence
  Synthetic oligonucleotide
gguuuauggucuucaaguguuuagcca

SEQ ID NO: 351 - RNA, 27 nt, Artificial Sequence
  Synthetic oligonucleotide
ugguuuauggucuucaaguguuuagcc

SEQ ID NO: 352 - RNA, 27 nt, Artificial Sequence
  Synthetic oligonucleotide
cuuucuugguuuauggucuucaagugu

SEQ ID NO: 353 - RNA, 27 nt, Artificial Sequence
  Synthetic oligonucleotide
gcuuucuugguuuauggucuucaagug

SEQ ID NO: 354 - RNA, 27 nt, Artificial Sequence
  Synthetic oligonucleotide
augcagcuuucuugguuuauggucuuc

SEQ ID NO: 355 - RNA, 27 nt, Artificial Sequence
  Synthetic oligonucleotide
gauacuuucugcuaaugguucgaugca

SEQ ID NO: 356 - RNA, 27 nt, Artificial Sequence
  Synthetic oligonucleotide
ugauacuuucugcuaaugguucgaugc

SEQ ID NO: 357 - RNA, 27 nt, Artificial Sequence
  Synthetic oligonucleotide
gucugugauacuuucugcuaaugguuc

SEQ ID NO: 358 - RNA, 27 nt, Artificial Sequence
  Synthetic oligonucleotide
ccucuuuguuuaacuagccagucccgu

SEQ ID NO: 359 - RNA, 27 nt, Artificial Sequence
  Synthetic oligonucleotide
gccucuuuguuuaacuagccagucccg

SEQ ID NO: 360 - RNA, 27 nt, Artificial Sequence
  Synthetic oligonucleotide
caucccagccucuuuguuuaacuagcc

SEQ ID NO: 361 - RNA, 27 nt, Artificial Sequence
  Synthetic oligonucleotide
caaacccaucccagccucuuuguuuaa

SEQ ID NO: 362 - RNA, 27 nt, Artificial Sequence
  Synthetic oligonucleotide
acaaacccaucccagccucuuuguuua

SEQ ID NO: 363 - RNA, 27 nt, Artificial Sequence
  Synthetic oligonucleotide
cacaaacccaucccagccucuuuguuu

SEQ ID NO: 364 - RNA, 27 nt, Artificial Sequence
  Synthetic oligonucleotide
ccacaaacccaucccagccucuuuguu

SEQ ID NO: 365 - RNA, 27 nt, Artificial Sequence
  Synthetic oligonucleotide
uccacaaacccaucccagccucuuugu

SEQ ID NO: 366 - RNA, 27 nt, Artificial Sequence
  Synthetic oligonucleotide
cuccacaaacccaucccagccucuuug

SEQ ID NO: 367 - RNA, 27 nt, Artificial Sequence
  Synthetic oligonucleotide
acuccacaaacccaucccagccucuuu

SEQ ID NO: 368 - RNA, 27 nt, Artificial Sequence
  Synthetic oligonucleotide
aacuccacaaacccaucccagccucuu

SEQ ID NO: 369 - RNA, 27 nt, Artificial Sequence
  Synthetic oligonucleotide
gaacuccacaaacccaucccagccucu

SEQ ID NO: 370 - RNA, 27 nt, Artificial Sequence
  Synthetic oligonucleotide
agaacuccacaaacccaucccagccuc

SEQ ID NO: 371 - RNA, 27 nt, Artificial Sequence
  Synthetic oligonucleotide
aagaacuccacaaacccaucccagccu

SEQ ID NO: 372 - RNA, 27 nt, Artificial Sequence
  Synthetic oligonucleotide
gaagaacuccacaaacccaucccagcc

SEQ ID NO: 373 - RNA, 27 nt, Artificial Sequence
  Synthetic oligonucleotide
ggaagaacuccacaaacccaucccagc

SEQ ID NO: 374 - RNA, 27 nt, Artificial Sequence
  Synthetic oligonucleotide
uggaagaacuccacaaacccaucccag

SEQ ID NO: 375 - RNA, 27 nt, Artificial Sequence
  Synthetic oligonucleotide
auggaagaacuccacaaacccauccca

SEQ ID NO: 376 - RNA, 27 nt, Artificial Sequence
  Synthetic oligonucleotide
cauggaagaacuccacaaacccauccc

SEQ ID NO: 377 - RNA, 27 nt, Artificial Sequence
  Synthetic oligonucleotide
acauggaagaacuccacaaacccaucc

SEQ ID NO: 378 - RNA, 27 nt, Artificial Sequence
  Synthetic oligonucleotide
uacauggaagaacuccacaaacccauc

SEQ ID NO: 379 - RNA, 27 nt, Artificial Sequence
  Synthetic oligonucleotide
cuacauggaagaacuccacaaacccau

SEQ ID NO: 380 - RNA, 27 nt, Artificial Sequence
  Synthetic oligonucleotide
ucuacauggaagaacuccacaaaccca

SEQ ID NO: 381 - RNA, 27 nt, Artificial Sequence
  Synthetic oligonucleotide
ucuagguccucuacauggaagaacucc

SEQ ID NO: 382 - RNA, 27 nt, Artificial Sequence
  Synthetic oligonucleotide
gccaccuucuagguccucuacauggaa

SEQ ID NO: 383 - RNA, 27 nt, Artificial Sequence
  Synthetic oligonucleotide
auuccugaugccaccuucuagguccuc

SEQ ID NO: 384 - RNA, 27 nt, Artificial Sequence
  Synthetic oligonucleotide
aaccagcuccuacuccagcaacaccug

SEQ ID NO: 385 - RNA, 27 nt, Artificial Sequence
  Synthetic oligonucleotide
uaucuuauuagauaugccaaaccagcu

SEQ ID NO: 386 - RNA, 27 nt, Artificial Sequence
  Synthetic oligonucleotide
uaaggcuaucuuauuagauaugccaaa

SEQ ID NO: 387 - RNA, 27 nt, Artificial Sequence
  Synthetic oligonucleotide
guaaggcuaucuuauuagauaugccaa

SEQ ID NO: 388 - RNA, 27 nt, Artificial Sequence
  Synthetic oligonucleotide
aguaaggcuaucuuauuagauaugcca

SEQ ID NO: 389 - RNA, 27 nt, Artificial Sequence
  Synthetic oligonucleotide
caguaaggcuaucuuauuagauaugcc

SEQ ID NO: 390 - RNA, 27 nt, Artificial Sequence
  Synthetic oligonucleotide
acaguaaggcuaucuuauuagauaugc

SEQ ID NO: 391 - RNA, 27 nt, Artificial Sequence
  Synthetic oligonucleotide
uacaguaaggcuaucuuauuagauaug

SEQ ID NO: 392 - RNA, 27 nt, Artificial Sequence
  Synthetic oligonucleotide
ucaacuauugcacuuacaguaaggcua

SEQ ID NO: 393 - RNA, 27 nt, Artificial Sequence
  Synthetic oligonucleotide
ucuaggaaguuacagcuuggaguccaa

SEQ ID NO: 394 - RNA, 27 nt, Artificial Sequence
  Synthetic oligonucleotide
gguugcuagggugcaacucuaggaagu

SEQ ID NO: 395 - RNA, 27 nt, Artificial Sequence
  Synthetic oligonucleotide
uagccauaauccucuugccacuugcuu

SEQ ID NO: 396 - RNA, 27 nt, Artificial Sequence
  Synthetic oligonucleotide
cuuguuagccauaauccucuugccacu

SEQ ID NO: 397 - RNA, 27 nt, Artificial Sequence
  Synthetic oligonucleotide
ucuuguuagccauaauccucuugccac

SEQ ID NO: 398 - RNA, 27 nt, Artificial Sequence
  Synthetic oligonucleotide
uuuauucuuguuagccauaauccucuu

SEQ ID NO: 399 - RNA, 27 nt, Artificial Sequence
  Synthetic oligonucleotide
cccauguauuuauucuuguuagccaua

SEQ ID NO: 400 - RNA, 27 nt, Artificial Sequence
  Synthetic oligonucleotide
ucccauguauuuauucuuguuagccau

SEQ ID NO: 401 - RNA, 27 nt, Artificial Sequence
  Synthetic oligonucleotide
uucccauguauuuauucuuguuagcca

SEQ ID NO: 402 - RNA, 27 nt, Artificial Sequence
  Synthetic oligonucleotide
cuucccauguauuuauucuuguuagcc

SEQ ID NO: 403 - RNA, 27 nt, Artificial Sequence
  Synthetic oligonucleotide
ucuucccauguauuuauucuuguuagc

SEQ ID NO: 404 - RNA, 27 nt, Artificial Sequence
  Synthetic oligonucleotide
cucuucccauguauuuauucuuguuag

SEQ ID NO: 405 - RNA, 27 nt, Artificial Sequence
  Synthetic oligonucleotide
acucuucccauguauuuauucuuguua

SEQ ID NO: 406 - RNA, 27 nt, Artificial Sequence
  Synthetic oligonucleotide
cacucuucccauguauuuauucuuguu

SEQ ID NO: 407 - RNA, 27 nt, Artificial Sequence
  Synthetic oligonucleotide
gcacucuucccauguauuuauucuugu

SEQ ID NO: 408 - RNA, 27 nt, Artificial Sequence
  Synthetic oligonucleotide
agcacucuucccauguauuuauucuug

SEQ ID NO: 409 - RNA, 27 nt, Artificial Sequence
  Synthetic oligonucleotide
ucagacagugacucuucaaucaauggg

SEQ ID NO: 410 - RNA, 27 nt, Artificial Sequence
  Synthetic oligonucleotide
acugaacuuugcuucuuucagacagug

SEQ ID NO: 411 - RNA, 27 nt, Artificial Sequence
  Synthetic oligonucleotide
ccauagcuucccaaacaaaguuuguuu

SEQ ID NO: 412 - RNA, 27 nt, Artificial Sequence
  Synthetic oligonucleotide
caucuucacuaaaucuaaaaguccucc

SEQ ID NO: 413 - RNA, 27 nt, Artificial Sequence
  Synthetic oligonucleotide
auuaagucuuuccacccuaccaucuuc

SEQ ID NO: 414 - RNA, 27 nt, Artificial Sequence
  Synthetic oligonucleotide
uggccacuuuccuguucucaacaagga

SEQ ID NO: 415 - RNA, 27 nt, Artificial Sequence
  Synthetic oligonucleotide
uaaucaauucuaugacuugccuggcua

SEQ ID NO: 416 - RNA, 27 nt, Artificial Sequence
  Synthetic oligonucleotide
ggguaaucaauucuaugacuugccugg

SEQ ID NO: 417 - RNA, 27 nt, Artificial Sequence
  Synthetic oligonucleotide
cggguaaucaauucuaugacuugccug

SEQ ID NO: 418 - RNA, 27 nt, Artificial Sequence
  Synthetic oligonucleotide
acaguaaauuaaugaauucggcgggua

SEQ ID NO: 419 - RNA, 27 nt, Artificial Sequence
  Synthetic oligonucleotide
acacuacaguaaauuaaugaauucggc

SEQ ID NO: 420 - RNA, 27 nt, Artificial Sequence
  Synthetic oligonucleotide
gcauucuuagugcuucucuuaacacua

SEQ ID NO: 421 - RNA, 27 nt, Artificial Sequence
  Synthetic oligonucleotide
acaggucacuggcauucuuagugcuuc

SEQ ID NO: 422 - RNA, 27 nt, Artificial Sequence
  Synthetic oligonucleotide
gcuuacagucauaguucuauuacuugu

SEQ ID NO: 423 - RNA, 27 nt, Artificial Sequence
  Synthetic oligonucleotide
aggcuuacagucauaguucuauuacuu

SEQ ID NO: 424 - RNA, 27 nt, Artificial Sequence
  Synthetic oligonucleotide
aaagcuucccuuguacaguacugaggc

SEQ ID NO: 425 - RNA, 27 nt, Artificial Sequence
  Synthetic oligonucleotide
uuggacuuucuaagaaguauacuggga

SEQ ID NO: 426 - RNA, 27 nt, Artificial Sequence
  Synthetic oligonucleotide
ggaaaccaagccaaaguauaacaggua

SEQ ID NO: 427 - RNA, 27 nt, Artificial Sequence
  Synthetic oligonucleotide
caaguauuauuggugauaaacuaggcu

SEQ ID NO: 428 - RNA, 27 nt, Artificial Sequence
  Synthetic oligonucleotide
agccuuccgucaaguauuauuggugau

SEQ ID NO: 429 - RNA, 27 nt, Artificial Sequence
  Synthetic oligonucleotide
gagccuuccgucaaguauuauugguga

SEQ ID NO: 430 - RNA, 27 nt, Artificial Sequence
  Synthetic oligonucleotide
ugagccuuccgucaaguauuauuggug

SEQ ID NO: 431 - RNA, 27 nt, Artificial Sequence
  Synthetic oligonucleotide
cauauucauaacuaauuacugagccuu

SEQ ID NO: 432 - RNA, 27 nt, Artificial Sequence
  Synthetic oligonucleotide
uauccauauucauaacuaauuacugag

SEQ ID NO: 433 - RNA, 27 nt, Artificial Sequence
  Synthetic oligonucleotide
aauacauuuacaagcugucuuaagaau

SEQ ID NO: 434 - RNA, 27 nt, Artificial Sequence
  Synthetic oligonucleotide
ucuguaaaaauauauacaauuuuuaca

SEQ ID NO: 435 - RNA, 27 nt, Artificial Sequence
  Synthetic oligonucleotide
guuucaaagaaauagacuuucuguaaa

SEQ ID NO: 436 - RNA, 27 nt, Artificial Sequence
  Synthetic oligonucleotide
cguuucaaagaaauagacuuucuguaa

SEQ ID NO: 437 - RNA, 27 nt, Artificial Sequence
  Synthetic oligonucleotide
ucguuucaaagaaauagacuuucugua

SEQ ID NO: 438 - RNA, 27 nt, Artificial Sequence
  Synthetic oligonucleotide
uucguuucaaagaaauagacuuucugu

SEQ ID NO: 439 - RNA, 27 nt, Artificial Sequence
  Synthetic oligonucleotide
cuucguuucaaagaaauagacuuucug

SEQ ID NO: 440 - RNA, 27 nt, Artificial Sequence
  Synthetic oligonucleotide
uaauguaaauucgauacuuccuucguu

SEQ ID NO: 441 - RNA, 27 nt, Artificial Sequence
  Synthetic oligonucleotide
uaugaaaaaaacuaauguaaauucgau

SEQ ID NO: 442 - RNA, 27 nt, Artificial Sequence
  Synthetic oligonucleotide
uuccuaauuacggaaguugcaaaguuc

SEQ ID NO: 443 - RNA, 27 nt, Artificial Sequence
  Synthetic oligonucleotide
cacaucaauucguucuguauacacucu

SEQ ID NO: 444 - RNA, 27 nt, Artificial Sequence
  Synthetic oligonucleotide
ccugcauaguuaucagauuuguuccac

SEQ ID NO: 445 - RNA, 27 nt, Artificial Sequence
  Synthetic oligonucleotide
acuuaccaaaaucagauaagaaaauuu

SEQ ID NO: 446 - RNA, 27 nt, Artificial Sequence
  Synthetic oligonucleotide
aaucccagguuuucaaagaaaaaccua

SEQ ID NO: 447 - RNA, 27 nt, Artificial Sequence
  Synthetic oligonucleotide
uuccauucaucaaccucucaaucccag

SEQ ID NO: 448 - RNA, 27 nt, Artificial Sequence
  Synthetic oligonucleotide
aaagaauuuccauucaucaaccucuca

SEQ ID NO: 449 - RNA, 27 nt, Artificial Sequence
  Synthetic oligonucleotide
agugaaagaauuuccauucaucaaccu

SEQ ID NO: 450 - RNA, 27 nt, Artificial Sequence
  Synthetic oligonucleotide
gaccuaauuauugaaaacuugcauaua

SEQ ID NO: 451 - RNA, 27 nt, Artificial Sequence
  Synthetic oligonucleotide
cauuauuuguaagucaucaguaaccuu

SEQ ID NO: 452 - RNA, 27 nt, Artificial Sequence
  Synthetic oligonucleotide
aaggaacucaaaugaguauugcccaau

SEQ ID NO: 453 - RNA, 27 nt, Artificial Sequence
  Synthetic oligonucleotide
ucaccaguuaaauuaggucaaauggaa

SEQ ID NO: 454 - RNA, 27 nt, Artificial Sequence
  Synthetic oligonucleotide
cugaaaaucuuuuaguaaaagcuuuaa

SEQ ID NO: 455 - RNA, 27 nt, Artificial Sequence
  Synthetic oligonucleotide
gggaucaaaugucucuccauccaccug

SEQ ID NO: 456 - RNA, 27 nt, Artificial Sequence
  Synthetic oligonucleotide
agccaucauuuuauaauuuauuaagca

SEQ ID NO: 457 - RNA, 27 nt, Artificial Sequence
  Synthetic oligonucleotide
gcaagccuaauaauagcaccaugguua

SEQ ID NO: 458 - RNA, 27 nt, Artificial Sequence
  Synthetic oligonucleotide
auuugcuuuauugacauacuaggcuua

SEQ ID NO: 459 - RNA, 27 nt, Artificial Sequence
  Synthetic oligonucleotide
ggaaucauuaauagaaacaaaacagua

SEQ ID NO: 460 - RNA, 27 nt, Artificial Sequence
  Synthetic oligonucleotide
aacaagguuugggaaucauuaauagaa

SEQ ID NO: 461 - RNA, 27 nt, Artificial Sequence
  Synthetic oligonucleotide
gaugccaaugcaaaaacuugcaacaag

SEQ ID NO: 462 - RNA, 27 nt, Artificial Sequence
  Synthetic oligonucleotide
agaacaaacaucaagacugaaauccaa

SEQ ID NO: 463 - RNA, 27 nt, Artificial Sequence
  Synthetic oligonucleotide
gcagaacaaucagcaauuucaaggaag

SEQ ID NO: 464 - RNA, 27 nt, Artificial Sequence
  Synthetic oligonucleotide
auugauauaaauaucuguagagggagc

SEQ ID NO: 465 - RNA, 27 nt, Artificial Sequence
  Synthetic oligonucleotide
gaugaaaggucuguggacucuuggugg

SEQ ID NO: 466 - RNA, 27 nt, Artificial Sequence
  Synthetic oligonucleotide
agaugaaaggucuguggacucuuggug

SEQ ID NO: 467 - RNA, 27 nt, Artificial Sequence
  Synthetic oligonucleotide
cgugaaagaugaaaggucuguggacuc

SEQ ID NO: 468 - RNA, 27 nt, Artificial Sequence
  Synthetic oligonucleotide
ucgugaaagaugaaaggucuguggacu

SEQ ID NO: 469 - RNA, 27 nt, Artificial Sequence
  Synthetic oligonucleotide
uucgugaaagaugaaaggucuguggac

SEQ ID NO: 470 - RNA, 27 nt, Artificial Sequence
  Synthetic oligonucleotide
guucgugaaagaugaaaggucugugga

SEQ ID NO: 471 - RNA, 27 nt, Artificial Sequence
  Synthetic oligonucleotide
caaguucgugaaagaugaaaggucugu

SEQ ID NO: 472 - RNA, 27 nt, Artificial Sequence
  Synthetic oligonucleotide
gaucaaguucgugaaagaugaaagguc

SEQ ID NO: 473 - RNA, 27 nt, Artificial Sequence
  Synthetic oligonucleotide
accucucaaugacuguuagugucacag

SEQ ID NO: 474 - RNA, 27 nt, Artificial Sequence
  Synthetic oligonucleotide
ccucccaccucucaaugacuguuagug

SEQ ID NO: 475 - RNA, 27 nt, Artificial Sequence
  Synthetic oligonucleotide
cuguaaauuuaagugagcauacuccua

SEQ ID NO: 476 - RNA, 27 nt, Artificial Sequence
  Synthetic oligonucleotide
caccucuuucuguaaauuuaagugagc

SEQ ID NO: 477 - RNA, 27 nt, Artificial Sequence
  Synthetic oligonucleotide
gcucaccucuuucuguaaauuuaagug

SEQ ID NO: 478 - RNA, 27 nt, Artificial Sequence
  Synthetic oligonucleotide
uuccaauauagacacuuucuucaguuu

SEQ ID NO: 479 - RNA, 27 nt, Artificial Sequence
  Synthetic oligonucleotide
gaagcuuucaaaugacccuaguuccaa

SEQ ID NO: 480 - RNA, 27 nt, Artificial Sequence
  Synthetic oligonucleotide
gacugaagcuuucaaaugacccuaguu

SEQ ID NO: 481 - RNA, 27 nt, Artificial Sequence
  Synthetic oligonucleotide
agacugaagcuuucaaaugacccuagu

SEQ ID NO: 482 - RNA, 27 nt, Artificial Sequence
  Synthetic oligonucleotide
gagacugaagcuuucaaaugacccuag

SEQ ID NO: 483 - RNA, 27 nt, Artificial Sequence
  Synthetic oligonucleotide
cgagacugaagcuuucaaaugacccua

SEQ ID NO: 484 - RNA, 27 nt, Artificial Sequence
  Synthetic oligonucleotide
ccgagacugaagcuuucaaaugacccu

SEQ ID NO: 485 - RNA, 27 nt, Artificial Sequence
  Synthetic oligonucleotide
agacuaaaggucauguuccgagacuga

SEQ ID NO: 486 - RNA, 27 nt, Artificial Sequence
  Synthetic oligonucleotide
aguccacagacuaaaggucauguuccg

SEQ ID NO: 487 - RNA, 27 nt, Artificial Sequence
  Synthetic oligonucleotide
ggaguccacagacuaaaggucauguuc

SEQ ID NO: 488 - RNA, 27 nt, Artificial Sequence
  Synthetic oligonucleotide
ucuuauucauaccuauuuuuaaaugga

SEQ ID NO: 489 - RNA, 27 nt, Artificial Sequence
  Synthetic oligonucleotide
cauucuuagucaucuuauucauaccua

SEQ ID NO: 490 - RNA, 27 nt, Artificial Sequence
  Synthetic oligonucleotide
augaccuuauggcucugagaugggcag

SEQ ID NO: 491 - RNA, 27 nt, Artificial Sequence
  Synthetic oligonucleotide
gaucaagaacgauaaauacauagguaa

SEQ ID NO: 492 - RNA, 27 nt, Artificial Sequence
  Synthetic oligonucleotide
gagauacaugauauaaauaagcggcuu

SEQ ID NO: 493 - RNA, 27 nt, Artificial Sequence
  Synthetic oligonucleotide
gaucuuaagauuaauuaaaaacuacau

SEQ ID NO: 494 - RNA, 27 nt, Artificial Sequence
  Synthetic oligonucleotide
guuuccacuggauuuggcagacaggcu

SEQ ID NO: 495 - RNA, 27 nt, Artificial Sequence
  Synthetic oligonucleotide
gcacuuguuuccacuggauuuggcaga

SEQ ID NO: 496 - RNA, 27 nt, Artificial Sequence
  Synthetic oligonucleotide
ucacaucuaugcacuuguuuccacugg

SEQ ID NO: 497 - RNA, 27 nt, Artificial Sequence
  Synthetic oligonucleotide
aauucacaucuaugcacuuguuuccac

SEQ ID NO: 498 - RNA, 27 nt, Artificial Sequence
  Synthetic oligonucleotide
agucauaccuaaugaauugggaagugg

SEQ ID NO: 499 - RNA, 27 nt, Artificial Sequence
  Synthetic oligonucleotide
uugucuguauuuccacagucauaccua

SEQ ID NO: 500 - RNA, 27 nt, Artificial Sequence
  Synthetic oligonucleotide
gauccuugucuguauuuccacagucau

SEQ ID NO: 501 - RNA, 27 nt, Artificial Sequence
  Synthetic oligonucleotide
agauccuugucuguauuuccacaguca

SEQ ID NO: 502 - RNA, 27 nt, Artificial Sequence
  Synthetic oligonucleotide
uaagauccuugucuguauuuccacagu

SEQ ID NO: 503 - RNA, 27 nt, Artificial Sequence
  Synthetic oligonucleotide
cuaagauccuugucuguauuuccacag

SEQ ID NO: 504 - RNA, 27 nt, Artificial Sequence
  Synthetic oligonucleotide
acuaagauccuugucuguauuuccaca

SEQ ID NO: 505 - RNA, 27 nt, Artificial Sequence
  Synthetic oligonucleotide
aacuaagauccuugucuguauuuccac

SEQ ID NO: 506 - RNA, 27 nt, Artificial Sequence
  Synthetic oligonucleotide
caacuaagauccuugucuguauuucca

SEQ ID NO: 507 - RNA, 27 nt, Artificial Sequence
  Synthetic oligonucleotide
agcacuuagaccaccugccuccuccuc

SEQ ID NO: 508 - RNA, 27 nt, Artificial Sequence
  Synthetic oligonucleotide
ggaggauuugcccgaacuacguagcca

SEQ ID NO: 509 - RNA, 27 nt, Artificial Sequence
  Synthetic oligonucleotide
agcgccauccuucuaagcaaauccucc

SEQ ID NO: 510 - RNA, 27 nt, Artificial Sequence
  Synthetic oligonucleotide
gagcgccauccuucuaagcaaauccuc

SEQ ID NO: 511 - RNA, 27 nt, Artificial Sequence
  Synthetic oligonucleotide
cagaauguacaugaaacacuagaggac

SEQ ID NO: 512 - RNA, 27 nt, Artificial Sequence
  Synthetic oligonucleotide
agcuguuuaaccagaaccaagguguuc

SEQ ID NO: 513 - RNA, 27 nt, Artificial Sequence
  Synthetic oligonucleotide
gguccuaacccuuccuggcacagcuau

SEQ ID NO: 514 - RNA, 27 nt, Artificial Sequence
  Synthetic oligonucleotide
uuuguaguugguccuaacccuuccugg

SEQ ID NO: 515 - RNA, 27 nt, Artificial Sequence
  Synthetic oligonucleotide
cauuaauuuguaguugguccuaacccu

SEQ ID NO: 516 - RNA, 27 nt, Artificial Sequence
  Synthetic oligonucleotide
agucaggagugaggaaggccguucccu

SEQ ID NO: 517 - RNA, 27 nt, Artificial Sequence
  Synthetic oligonucleotide
caagccgaugaccgcguuucuccgcag

SEQ ID NO: 518 - RNA, 27 nt, Artificial Sequence
  Synthetic oligonucleotide
cucgcagccguccaguuccuccuccgg

SEQ ID NO: 519 - RNA, 27 nt, Artificial Sequence
  Synthetic oligonucleotide
cgguauaggucguccucuuccuccucg

SEQ ID NO: 520 - RNA, 27 nt, Artificial Sequence
  Synthetic oligonucleotide
gcgguauaggucguccucuuccuccuc

SEQ ID NO: 521 - RNA, 27 nt, Artificial Sequence
  Synthetic oligonucleotide
ggcgguauaggucguccucuuccuccu

SEQ ID NO: 522 - RNA, 27 nt, Artificial Sequence
  Synthetic oligonucleotide
cuggcgguauaggucguccucuuccuc

SEQ ID NO: 523 - RNA, 27 nt, Artificial Sequence
  Synthetic oligonucleotide
ccgaaagaaauaagagucacaauccug

SEQ ID NO: 524 - RNA, 27 nt, Artificial Sequence
  Synthetic oligonucleotide
uuuacgcucuuuaaguguuuggccaca

SEQ ID NO: 525 - RNA, 27 nt, Artificial Sequence
  Synthetic oligonucleotide
guuuacgcucuuuaaguguuuggccac

SEQ ID NO: 526 - RNA, 27 nt, Artificial Sequence
  Synthetic oligonucleotide
gguuuacgcucuuuaaguguuuggcca

SEQ ID NO: 527 - RNA, 27 nt, Artificial Sequence
  Synthetic oligonucleotide
augaagcuuucuugguuuacgcucuuu

SEQ ID NO: 528 - RNA, 27 nt, Artificial Sequence
  Synthetic oligonucleotide
ucugugauaguuucugcuaaugguucg

SEQ ID NO: 529 - RNA, 27 nt, Artificial Sequence
  Synthetic oligonucleotide
aagaacaucugugauaguuucugcuaa

SEQ ID NO: 530 - RNA, 27 nt, Artificial Sequence
  Synthetic oligonucleotide
ccucuuuguuugacaagccagucccgu

SEQ ID NO: 531 - RNA, 27 nt, Artificial Sequence
  Synthetic oligonucleotide
gccucuuuguuugacaagccagucccg

SEQ ID NO: 532 - RNA, 27 nt, Artificial Sequence
  Synthetic oligonucleotide
gguccuguacguggaagaacuccacaa

SEQ ID NO: 533 - RNA, 27 nt, Artificial Sequence
  Synthetic oligonucleotide
ucuagguccuguacguggaagaacucc

SEQ ID NO: 534 - RNA, 27 nt, Artificial Sequence
  Synthetic oligonucleotide
gccgccuucuagguccuguacguggaa

SEQ ID NO: 535 - RNA, 27 nt, Artificial Sequence
  Synthetic oligonucleotide
gcuaucuuauuagauaugccagaccag

SEQ ID NO: 536 - RNA, 27 nt, Artificial Sequence
  Synthetic oligonucleotide
uucacagaugcauguaguuugguggcu

SEQ ID NO: 537 - RNA, 27 nt, Artificial Sequence
  Synthetic oligonucleotide
ucaaguccaccuucauaaauacacaug

SEQ ID NO: 538 - RNA, 27 nt, Artificial Sequence
  Synthetic oligonucleotide
cuucaaguccaccuucauaaauacaca

SEQ ID NO: 539 - RNA, 27 nt, Artificial Sequence
  Synthetic oligonucleotide
cagcuucaaguccaccuucauaaauac

SEQ ID NO: 540 - RNA, 27 nt, Artificial Sequence
  Synthetic oligonucleotide
ugcuauguugcuacaguagaacuggac

SEQ ID NO: 541 - RNA, 27 nt, Artificial Sequence
  Synthetic oligonucleotide
uucauucagacagugacucuuccaggg

SEQ ID NO: 542 - RNA, 27 nt, Artificial Sequence
  Synthetic oligonucleotide
cuucauucagacagugacucuuccagg

SEQ ID NO: 543 - RNA, 27 nt, Artificial Sequence
  Synthetic oligonucleotide
gcuucauucagacagugacucuuccag

SEQ ID NO: 544 - RNA, 27 nt, Artificial Sequence
  Synthetic oligonucleotide
agggaacuuugcuucauucagacagug

SEQ ID NO: 545 - RNA, 27 nt, Artificial Sequence
  Synthetic oligonucleotide
ggccucucaguguuugcugagagggaa

SEQ ID NO: 546 - RNA, 27 nt, Artificial Sequence
  Synthetic oligonucleotide
uggccucucaguguuugcugagaggga

SEQ ID NO: 547 - RNA, 27 nt, Artificial Sequence
  Synthetic oligonucleotide
ucuccauggccucucaguguuugcuga

SEQ ID NO: 548 - RNA, 27 nt, Artificial Sequence
  Synthetic oligonucleotide
aguccuucuccauggccucucaguguu

SEQ ID NO: 549 - RNA, 27 nt, Artificial Sequence
  Synthetic oligonucleotide
auucuagaaguccuucuccauggccuc

SEQ ID NO: 550 - RNA, 27 nt, Artificial Sequence
  Synthetic oligonucleotide
cauucuagaaguccuucuccauggccu

SEQ ID NO: 551 - RNA, 27 nt, Artificial Sequence
  Synthetic oligonucleotide
uucauucauucuagaaguccuucucca

SEQ ID NO: 552 - RNA, 27 nt, Artificial Sequence
  Synthetic oligonucleotide
cccuuucauucauucuagaaguccuuc

SEQ ID NO: 553 - RNA, 27 nt, Artificial Sequence
  Synthetic oligonucleotide
gauaggaaaucaaaccuuuccauccac

SEQ ID NO: 554 - RNA, 27 nt, Artificial Sequence
  Synthetic oligonucleotide
gagcuuugugacuagccugaugacugg

SEQ ID NO: 555 - RNA, 27 nt, Artificial Sequence
  Synthetic oligonucleotide
ugagcuuugugacuagccugaugacug

SEQ ID NO: 556 - RNA, 27 nt, Artificial Sequence
  Synthetic oligonucleotide
auauuuauugagcuuugugacuagccu

SEQ ID NO: 557 - RNA, 27 nt, Artificial Sequence
  Synthetic oligonucleotide
agucaccaacguuguuaauuagggcuu

SEQ ID NO: 558 - RNA, 27 nt, Artificial Sequence
  Synthetic oligonucleotide
uagucaucguuuggugacuuguagguu

SEQ ID NO: 559 - RNA, 27 nt, Artificial Sequence
  Synthetic oligonucleotide
cuagucaucguuuggugacuuguaggu

SEQ ID NO: 560 - RNA, 27 nt, Artificial Sequence
  Synthetic oligonucleotide
gcagcuucuagucaucguuuggugacu

SEQ ID NO: 561 - RNA, 27 nt, Artificial Sequence
  Synthetic oligonucleotide
ugcagcuucuagucaucguuuggugac

SEQ ID NO: 562 - RNA, 27 nt, Artificial Sequence
  Synthetic oligonucleotide
cugcagcuucuagucaucguuugguga

SEQ ID NO: 563 - RNA, 27 nt, Artificial Sequence
  Synthetic oligonucleotide
acugcagcuucuagucaucguuuggug

SEQ ID NO: 564 - RNA, 27 nt, Artificial Sequence
  Synthetic oligonucleotide
gcucagaggccucccuucacauuccug

SEQ ID NO: 565 - RNA, 27 nt, Artificial Sequence
  Synthetic oligonucleotide
ugagcacuugggacuuugucaagcaca

SEQ ID NO: 566 - RNA, 27 nt, Artificial Sequence
  Synthetic oligonucleotide
cugagcacuugggacuuugucaagcac

SEQ ID NO: 567 - RNA, 27 nt, Artificial Sequence
  Synthetic oligonucleotide
aguccugagcacuugggacuuugucaa

SEQ ID NO: 568 - RNA, 27 nt, Artificial Sequence
  Synthetic oligonucleotide
ccaaaccaagccaaaguagacagggcu

SEQ ID NO: 569 - RNA, 27 nt, Artificial Sequence
  Synthetic oligonucleotide
ccaucacuaggcuaauaaacuuaagaa

SEQ ID NO: 570 - RNA, 27 nt, Artificial Sequence
  Synthetic oligonucleotide
auuagugaaccuuaagucaaguacuuu

SEQ ID NO: 571 - RNA, 27 nt, Artificial Sequence
  Synthetic oligonucleotide
uaaauccaagacuucccucuuauguuc

SEQ ID NO: 572 - RNA, 27 nt, Artificial Sequence
  Synthetic oligonucleotide
gaaauacauuucuaacuagagaagcug

SEQ ID NO: 573 - RNA, 27 nt, Artificial Sequence
  Synthetic oligonucleotide
ucugcauauacacuagaacggaugaca

SEQ ID NO: 574 - RNA, 27 nt, Artificial Sequence
  Synthetic oligonucleotide
uauaaaucuauaaccaguccacacaca

SEQ ID NO: 575 - RNA, 27 nt, Artificial Sequence
  Synthetic oligonucleotide
gauuggauaauuaacccugcauaguua

SEQ ID NO: 576 - RNA, 27 nt, Artificial Sequence
  Synthetic oligonucleotide
aaugucuuacaucuaucuaccugugau

SEQ ID NO: 577 - RNA, 27 nt, Artificial Sequence
  Synthetic oligonucleotide
gaucaaaugucuuacaucuaucuaccu

SEQ ID NO: 578 - RNA, 27 nt, Artificial Sequence
  Synthetic oligonucleotide
aagacucuagccugcuuuaccauuuac

SEQ ID NO: 579 - RNA, 27 nt, Artificial Sequence
  Synthetic oligonucleotide
acaaguaaacccagugaauagcaccau

SEQ ID NO: 580 - RNA, 27 nt, Artificial Sequence
  Synthetic oligonucleotide
gcuuggcaauccuuaguagacaagaaa

SEQ ID NO: 581 - RNA, 27 nt, Artificial Sequence
  Synthetic oligonucleotide
ggaaguaaaggcuacaccuagagacca

SEQ ID NO: 582 - RNA, 27 nt, Artificial Sequence
  Synthetic oligonucleotide
ggaggaaguguagacgacucuauaggg

SEQ ID NO: 583 - RNA, 27 nt, Artificial Sequence
  Synthetic oligonucleotide
agagcacagggaggaaguguagacgac

SEQ ID NO: 584 - RNA, 27 nt, Artificial Sequence
  Synthetic oligonucleotide
gggugagaguucuaaugcagauaacua

SEQ ID NO: 585 - RNA, 27 nt, Artificial Sequence
  Synthetic oligonucleotide
gaaagcugugcugacucugauuaggau

SEQ ID NO: 586 - RNA, 27 nt, Artificial Sequence
  Synthetic oligonucleotide
guuccuauccucugacaggaaagcugu

SEQ ID NO: 587 - RNA, 27 nt, Artificial Sequence
  Synthetic oligonucleotide
gcaaguguuccuauccucugacaggaa

SEQ ID NO: 588 - RNA, 27 nt, Artificial Sequence
  Synthetic oligonucleotide
agagcaaguguuccuauccucugacag

SEQ ID NO: 589 - RNA, 27 nt, Artificial Sequence
  Synthetic oligonucleotide
aagagcaaguguuccuauccucugaca

SEQ ID NO: 590 - RNA, 27 nt, Artificial Sequence
  Synthetic oligonucleotide
aaugccaaucccuggucacugucgguc

SEQ ID NO: 591 - RNA, 27 nt, Artificial Sequence
  Synthetic oligonucleotide
auagacaaaguaacaauggaaagcaug

SEQ ID NO: 592 - RNA, 27 nt, Artificial Sequence
  Synthetic oligonucleotide
aaguauaaacguauaauuuccaaccuu

SEQ ID NO: 593 - RNA, 27 nt, Artificial Sequence
  Synthetic oligonucleotide
acagucauacuuggagcaaacuaauaa

SEQ ID NO: 594 - RNA, 27 nt, Artificial Sequence
  Synthetic oligonucleotide
cccaguguuucucuaaacuuaagugaa

SEQ ID NO: 595 - RNA, 27 nt, Artificial Sequence
  Synthetic oligonucleotide
agcuuaaauaccuucaguuaccagugg

SEQ ID NO: 596 - RNA, 27 nt, Artificial Sequence
  Synthetic oligonucleotide
cugacuaaaggucacauucugaggcug

SEQ ID NO: 597 - RNA, 27 nt, Artificial Sequence
  Synthetic oligonucleotide
uucuuagucauuugauuccugccuauu

SEQ ID NO: 598 - RNA, 27 nt, Artificial Sequence
  Synthetic oligonucleotide
auucuuagucauuugauuccugccuau

SEQ ID NO: 599 - RNA, 27 nt, Artificial Sequence
  Synthetic oligonucleotide
cauucuuagucauuugauuccugccua

SEQ ID NO: 600 - RNA, 27 nt, Artificial Sequence
  Synthetic oligonucleotide
acauucuuagucauuugauuccugccu

SEQ ID NO: 601 - RNA, 27 nt, Artificial Sequence
  Synthetic oligonucleotide
uacauucuuagucauuugauuccugcc

SEQ ID NO: 602 - RNA, 27 nt, Artificial Sequence
  Synthetic oligonucleotide
uuacauucuuagucauuugauuccugc

SEQ ID NO: 603 - RNA, 27 nt, Artificial Sequence
  Synthetic oligonucleotide
auuacauucuuagucauuugauuccug

SEQ ID NO: 604 - RNA, 27 nt, Artificial Sequence
  Synthetic oligonucleotide
uauuacauucuuagucauuugauuccu

SEQ ID NO: 605 - RNA, 27 nt, Artificial Sequence
  Synthetic oligonucleotide
cuucuucccuauuacauucuuagucau

SEQ ID NO: 606 - RNA, 27 nt, Artificial Sequence
  Synthetic oligonucleotide
agguacaaaucacucccaagcuggcag

SEQ ID NO: 607 - RNA, 27 nt, Artificial Sequence
  Synthetic oligonucleotide
auaaauaagcaaacuaugaucaaggau

SEQ ID NO: 608 - RNA, 27 nt, Artificial Sequence
  Synthetic oligonucleotide
gguuuauucaacuacauaaagugcucu

SEQ ID NO: 609 - RNA, 27 nt, Artificial Sequence
  Synthetic oligonucleotide
ggguuuauucaacuacauaaagugcuc

SEQ ID NO: 610 - RNA, 27 nt, Artificial Sequence
  Synthetic oligonucleotide
ugggaagucaggcuccuaguaaacaaa

SEQ ID NO: 611 - RNA, 27 nt, Artificial Sequence
  Synthetic oligonucleotide
acccuuugugagcugggaagucaggcu

SEQ ID NO: 612 - RNA, 27 nt, Artificial Sequence
  Synthetic oligonucleotide
cacccuuugugagcugggaagucaggc

SEQ ID NO: 613 - RNA, 27 nt, Artificial Sequence
  Synthetic oligonucleotide
ucacccuuugugagcugggaagucagg

SEQ ID NO: 614 - RNA, 27 nt, Artificial Sequence
  Synthetic oligonucleotide
uuucauuucacccuuugugagcuggga

SEQ ID NO: 615 - RNA, 27 nt, Artificial Sequence
  Synthetic oligonucleotide
cagcuuucauuucacccuuugugagcu

SEQ ID NO: 616 - RNA, 27 nt, Artificial Sequence
  Synthetic oligonucleotide
cuacuaagauccugucuguacuucagc

SEQ ID NO: 617 - RNA, 27 nt, Artificial Sequence
  Synthetic oligonucleotide
uaccuacuaagauccugucuguacuuc

SEQ ID NO: 618 - RNA, 27 nt, Artificial Sequence
  Synthetic oligonucleotide
acugcgcucuccaagucuucauggccc

SEQ ID NO: 619 - RNA, 27 nt, Artificial Sequence
  Synthetic oligonucleotide
cagaccacaugcuucuucccuccaaag

SEQ ID NO: 620 - RNA, 27 nt, Artificial Sequence
  Synthetic oligonucleotide
cucaacuauucaucuagucagcacuca

SEQ ID NO: 621 - RNA, 27 nt, Artificial Sequence
  Synthetic oligonucleotide
ugugccucaacuauucaucuagucagc

SEQ ID NO: 622 - RNA, 27 nt, Artificial Sequence
  Synthetic oligonucleotide
ucccucuucucugaaggaugugccuca

SEQ ID NO: 623 - RNA, 27 nt, Artificial Sequence
  Synthetic oligonucleotide
cucccucuucucugaaggaugugccuc

SEQ ID NO: 624 - RNA, 27 nt, Artificial Sequence
  Synthetic oligonucleotide
gcugagagccaucuuuccaagcagccc

SEQ ID NO: 625 - RNA, 27 nt, Artificial Sequence
  Synthetic oligonucleotide
cugagagacguguaagacaaacagauu

SEQ ID NO: 626 - RNA, 27 nt, Artificial Sequence
  Synthetic oligonucleotide
agauagaauguacauggaagaugcuug

SEQ ID NO: 627 - RNA, 27 nt, Artificial Sequence
  Synthetic oligonucleotide
gaacagcuguuaaaguguuaggugcuc

SEQ ID NO: 628 - RNA, 27 nt, Artificial Sequence
  Synthetic oligonucleotide
gguccuaacccuuucgggaacagcugu

SEQ ID NO: 629 - RNA, 27 nt, Artificial Sequence
  Synthetic oligonucleotide
cuugcaguugguccuaacccuuucggg

SEQ ID NO: 630 - RNA, 27 nt, Artificial Sequence
  Synthetic oligonucleotide
acaacccacauuaacuugcaguugguc

SEQ ID NO: 631 - DNA, 27 bp, Artificial Sequence
  Synthetic oligonucleotide
tcgccacttctcacttccgcttccttc

SEQ ID NO: 632 - DNA, 27 bp, Artificial Sequence
  Synthetic oligonucleotide
ccacttctcacttccgcttccttccag

SEQ ID NO: 633 - DNA, 27 bp, Artificial Sequence
  Synthetic oligonucleotide
gcggcggcgactggcaatgtttggcct

SEQ ID NO: 634 - DNA, 27 bp, Artificial Sequence
  Synthetic oligonucleotide
aacgcggtaatcggactcaacctctac

SEQ ID NO: 635 - DNA, 27 bp, Artificial Sequence
  Synthetic oligonucleotide
ggagggcgacttttggctacggagaag

SEQ ID NO: 636 - DNA, 27 bp, Artificial Sequence
  Synthetic oligonucleotide
ccgcgaggctgcttttcttcgcgccca

SEQ ID NO: 637 - DNA, 27 bp, Artificial Sequence
  Synthetic oligonucleotide
tctggtaataacaccagtacggacggg

SEQ ID NO: 638 - DNA, 27 bp, Artificial Sequence
  Synthetic oligonucleotide
gaggaggaggacgagttgtaccggcag

SEQ ID NO: 639 - DNA, 27 bp, Artificial Sequence
  Synthetic oligonucleotide
accggcagtcgctggagattatctctc

SEQ ID NO: 640 - DNA, 27 bp, Artificial Sequence
  Synthetic oligonucleotide
gccaaggacacaaagccaatgggcagg

SEQ ID NO: 641 - DNA, 27 bp, Artificial Sequence
  Synthetic oligonucleotide
caggaaggcgctggagaccttacgacg

SEQ ID NO: 642 - DNA, 27 bp, Artificial Sequence
  Synthetic oligonucleotide
atggcgtgcagcgcaaccacgagacgg

SEQ ID NO: 643 - DNA, 27 bp, Artificial Sequence
  Synthetic oligonucleotide
tggcgtgcagcgcaaccacgagacggc

SEQ ID NO: 644 - DNA, 27 bp, Artificial Sequence
  Synthetic oligonucleotide
ggcgtgcagcgcaaccacgagacggcc

SEQ ID NO: 645 - DNA, 27 bp, Artificial Sequence
  Synthetic oligonucleotide
gcgtgcagcgcaaccacgagacggcct

SEQ ID NO: 646 - DNA, 27 bp, Artificial Sequence
  Synthetic oligonucleotide
cgtgcagcgcaaccacgagacggcctt

SEQ ID NO: 647 - DNA, 27 bp, Artificial Sequence
  Synthetic oligonucleotide
gtgcagcgcaaccacgagacggccttc

SEQ ID NO: 648 - DNA, 27 bp, Artificial Sequence
  Synthetic oligonucleotide
tgcagcgcaaccacgagacggccttcc

SEQ ID NO: 649 - DNA, 27 bp, Artificial Sequence
  Synthetic oligonucleotide
gcagcgcaaccacgagacggccttcca

SEQ ID NO: 650 - DNA, 27 bp, Artificial Sequence
  Synthetic oligonucleotide
cagcgcaaccacgagacggccttccaa

SEQ ID NO: 651 - DNA, 27 bp, Artificial Sequence
  Synthetic oligonucleotide
agcgcaaccacgagacggccttccaag

SEQ ID NO: 652 - DNA, 27 bp, Artificial Sequence
  Synthetic oligonucleotide
gcgcaaccacgagacggccttccaagg

SEQ ID NO: 653 - DNA, 27 bp, Artificial Sequence
  Synthetic oligonucleotide
cgcaaccacgagacggccttccaaggc

SEQ ID NO: 654 - DNA, 27 bp, Artificial Sequence
  Synthetic oligonucleotide
gcaaccacgagacggccttccaaggca

SEQ ID NO: 655 - DNA, 27 bp, Artificial Sequence
  Synthetic oligonucleotide
caaccacgagacggccttccaaggcat

SEQ ID NO: 656 - DNA, 27 bp, Artificial Sequence
  Synthetic oligonucleotide
ttccaaggcatgcttcggaaactggac

SEQ ID NO: 657 - DNA, 27 bp, Artificial Sequence
  Synthetic oligonucleotide
tccaaggcatgcttcggaaactggaca

SEQ ID NO: 658 - DNA, 27 bp, Artificial Sequence
  Synthetic oligonucleotide
aacgaagacgatgtgaaatcgttgtct

SEQ ID NO: 659 - DNA, 27 bp, Artificial Sequence
  Synthetic oligonucleotide
gacgatgtgaaatcgttgtctcgagtg

SEQ ID NO: 660 - DNA, 27 bp, Artificial Sequence
  Synthetic oligonucleotide
gggcaggattgtgactctcatttcttt

SEQ ID NO: 661 - DNA, 27 bp, Artificial Sequence
  Synthetic oligonucleotide
ttgtgactctcatttcttttggtgcct

SEQ ID NO: 662 - DNA, 27 bp, Artificial Sequence
  Synthetic oligonucleotide
gcctttgtggctaaacacttgaagacc

SEQ ID NO: 663 - DNA, 27 bp, Artificial Sequence
  Synthetic oligonucleotide
tgtggctaaacacttgaagaccataaa

SEQ ID NO: 664 - DNA, 27 bp, Artificial Sequence
  Synthetic oligonucleotide
gtggctaaacacttgaagaccataaac

SEQ ID NO: 665 - DNA, 27 bp, Artificial Sequence
  Synthetic oligonucleotide
tggctaaacacttgaagaccataaacc

SEQ ID NO: 666 - DNA, 27 bp, Artificial Sequence
  Synthetic oligonucleotide
ggctaaacacttgaagaccataaacca

SEQ ID NO: 667 - DNA, 27 bp, Artificial Sequence
  Synthetic oligonucleotide
acacttgaagaccataaaccaagaaag

SEQ ID NO: 668 - DNA, 27 bp, Artificial Sequence
  Synthetic oligonucleotide
cacttgaagaccataaaccaagaaagc

SEQ ID NO: 669 - DNA, 27 bp, Artificial Sequence
  Synthetic oligonucleotide
gaagaccataaaccaagaaagctgcat

SEQ ID NO: 670 - DNA, 27 bp, Artificial Sequence
  Synthetic oligonucleotide
tgcatcgaaccattagcagaaagtatc

SEQ ID NO: 671 - DNA, 27 bp, Artificial Sequence
  Synthetic oligonucleotide
gcatcgaaccattagcagaaagtatca

SEQ ID NO: 672 - DNA, 27 bp, Artificial Sequence
  Synthetic oligonucleotide
gaaccattagcagaaagtatcacagac

SEQ ID NO: 673 - DNA, 27 bp, Artificial Sequence
  Synthetic oligonucleotide
acgggactggctagttaaacaaagagg

SEQ ID NO: 674 - DNA, 27 bp, Artificial Sequence
  Synthetic oligonucleotide
cgggactggctagttaaacaaagaggc

SEQ ID NO: 675 - DNA, 27 bp, Artificial Sequence
  Synthetic oligonucleotide
ggctagttaaacaaagaggctgggatg

SEQ ID NO: 676 - DNA, 27 bp, Artificial Sequence
  Synthetic oligonucleotide
ttaaacaaagaggctgggatgggtttg

SEQ ID NO: 677 - DNA, 27 bp, Artificial Sequence
  Synthetic oligonucleotide
taaacaaagaggctgggatgggtttgt

SEQ ID NO: 678 - DNA, 27 bp, Artificial Sequence
  Synthetic oligonucleotide
aaacaaagaggctgggatgggtttgtg

SEQ ID NO: 679 - DNA, 27 bp, Artificial Sequence
  Synthetic oligonucleotide
aacaaagaggctgggatgggtttgtgg

SEQ ID NO: 680 - DNA, 27 bp, Artificial Sequence
  Synthetic oligonucleotide
acaaagaggctgggatgggtttgtgga

SEQ ID NO: 681 - DNA, 27 bp, Artificial Sequence
  Synthetic oligonucleotide
caaagaggctgggatgggtttgtggag

SEQ ID NO: 682 - DNA, 27 bp, Artificial Sequence
  Synthetic oligonucleotide
aaagaggctgggatgggtttgtggagt

SEQ ID NO: 683 - DNA, 27 bp, Artificial Sequence
  Synthetic oligonucleotide
aagaggctgggatgggtttgtggagtt

SEQ ID NO: 684 - DNA, 27 bp, Artificial Sequence
  Synthetic oligonucleotide
agaggctgggatgggtttgtggagttc

SEQ ID NO: 685 - DNA, 27 bp, Artificial Sequence
  Synthetic oligonucleotide
gaggctgggatgggtttgtggagttct

SEQ ID NO: 686 - DNA, 27 bp, Artificial Sequence
  Synthetic oligonucleotide
aggctgggatgggtttgtggagttctt

SEQ ID NO: 687 - DNA, 27 bp, Artificial Sequence
  Synthetic oligonucleotide
ggctgggatgggtttgtggagttcttc

SEQ ID NO: 688 - DNA, 27 bp, Artificial Sequence
  Synthetic oligonucleotide
gctgggatgggtttgtggagttcttcc

SEQ ID NO: 689 - DNA, 27 bp, Artificial Sequence
  Synthetic oligonucleotide
ctgggatgggtttgtggagttcttcca

SEQ ID NO: 690 - DNA, 27 bp, Artificial Sequence
  Synthetic oligonucleotide
tgggatgggtttgtggagttcttccat

SEQ ID NO: 691 - DNA, 27 bp, Artificial Sequence
  Synthetic oligonucleotide
gggatgggtttgtggagttcttccatg

SEQ ID NO: 692 - DNA, 27 bp, Artificial Sequence
  Synthetic oligonucleotide
ggatgggtttgtggagttcttccatgt

SEQ ID NO: 693 - DNA, 27 bp, Artificial Sequence
  Synthetic oligonucleotide
gatgggtttgtggagttcttccatgta

SEQ ID NO: 694 - DNA, 27 bp, Artificial Sequence
  Synthetic oligonucleotide
atgggtttgtggagttcttccatgtag

SEQ ID NO: 695 - DNA, 27 bp, Artificial Sequence
  Synthetic oligonucleotide
tgggtttgtggagttcttccatgtaga

SEQ ID NO: 696 - DNA, 27 bp, Artificial Sequence
  Synthetic oligonucleotide
ggagttcttccatgtagaggacctaga

SEQ ID NO: 697 - DNA, 27 bp, Artificial Sequence
  Synthetic oligonucleotide
ttccatgtagaggacctagaaggtggc

SEQ ID NO: 698 - DNA, 27 bp, Artificial Sequence
  Synthetic oligonucleotide
gaggacctagaaggtggcatcaggaat

SEQ ID NO: 699 - DNA, 27 bp, Artificial Sequence
  Synthetic oligonucleotide
caggtgttgctggagtaggagctggtt

SEQ ID NO: 700 - DNA, 27 bp, Artificial Sequence
  Synthetic oligonucleotide
agctggtttggcatatctaataagata

SEQ ID NO: 701 - DNA, 27 bp, Artificial Sequence
  Synthetic oligonucleotide
tttggcatatctaataagatagcctta

SEQ ID NO: 702 - DNA, 27 bp, Artificial Sequence
  Synthetic oligonucleotide
ttggcatatctaataagatagccttac

SEQ ID NO: 703 - DNA, 27 bp, Artificial Sequence
  Synthetic oligonucleotide
tggcatatctaataagatagccttact

SEQ ID NO: 704 - DNA, 27 bp, Artificial Sequence
  Synthetic oligonucleotide
ggcatatctaataagatagccttactg

SEQ ID NO: 705 - DNA, 27 bp, Artificial Sequence
  Synthetic oligonucleotide
gcatatctaataagatagccttactgt

SEQ ID NO: 706 - DNA, 27 bp, Artificial Sequence
  Synthetic oligonucleotide
catatctaataagatagccttactgta

SEQ ID NO: 707 - DNA, 27 bp, Artificial Sequence
  Synthetic oligonucleotide
tagccttactgtaagtgcaatagttga

SEQ ID NO: 708 - DNA, 27 bp, Artificial Sequence
  Synthetic oligonucleotide
ttggactccaagctgtaacttcctaga

SEQ ID NO: 709 - DNA, 27 bp, Artificial Sequence
  Synthetic oligonucleotide
acttcctagagttgcaccctagcaacc

SEQ ID NO: 710 - DNA, 27 bp, Artificial Sequence
  Synthetic oligonucleotide
aagcaagtggcaagaggattatggcta

SEQ ID NO: 711 - DNA, 27 bp, Artificial Sequence
  Synthetic oligonucleotide
agtggcaagaggattatggctaacaag

SEQ ID NO: 712 - DNA, 27 bp, Artificial Sequence
  Synthetic oligonucleotide
gtggcaagaggattatggctaacaaga

SEQ ID NO: 713 - DNA, 27 bp, Artificial Sequence
  Synthetic oligonucleotide
aagaggattatggctaacaagaataaa

SEQ ID NO: 714 - DNA, 27 bp, Artificial Sequence
  Synthetic oligonucleotide
tatggctaacaagaataaatacatggg

SEQ ID NO: 715 - DNA, 27 bp, Artificial Sequence
  Synthetic oligonucleotide
atggctaacaagaataaatacatggga

SEQ ID NO: 716 - DNA, 27 bp, Artificial Sequence
  Synthetic oligonucleotide
tggctaacaagaataaatacatgggaa

SEQ ID NO: 717 - DNA, 27 bp, Artificial Sequence
  Synthetic oligonucleotide
ggctaacaagaataaatacatgggaag

SEQ ID NO: 718 - DNA, 27 bp, Artificial Sequence
  Synthetic oligonucleotide
gctaacaagaataaatacatgggaaga

SEQ ID NO: 719 - DNA, 27 bp, Artificial Sequence
  Synthetic oligonucleotide
ctaacaagaataaatacatgggaagag

SEQ ID NO: 720 - DNA, 27 bp, Artificial Sequence
  Synthetic oligonucleotide
taacaagaataaatacatgggaagagt

SEQ ID NO: 721 - DNA, 27 bp, Artificial Sequence
  Synthetic oligonucleotide
aacaagaataaatacatgggaagagtg

SEQ ID NO: 722 - DNA, 27 bp, Artificial Sequence
  Synthetic oligonucleotide
acaagaataaatacatgggaagagtgc

SEQ ID NO: 723 - DNA, 27 bp, Artificial Sequence
  Synthetic oligonucleotide
caagaataaatacatgggaagagtgct

SEQ ID NO: 724 - DNA, 27 bp, Artificial Sequence
  Synthetic oligonucleotide
cccattgattgaagagtcactgtctga

SEQ ID NO: 725 - DNA, 27 bp, Artificial Sequence
  Synthetic oligonucleotide
cactgtctgaaagaagcaaagttcagt

SEQ ID NO: 726 - DNA, 27 bp, Artificial Sequence
  Synthetic oligonucleotide
aaacaaactttgtttgggaagctatgg

SEQ ID NO: 727 - DNA, 27 bp, Artificial Sequence
  Synthetic oligonucleotide
ggaggacttttagatttagtgaagatg

SEQ ID NO: 728 - DNA, 27 bp, Artificial Sequence
  Synthetic oligonucleotide
gaagatggtagggtggaaagacttaat

SEQ ID NO: 729 - DNA, 27 bp, Artificial Sequence
  Synthetic oligonucleotide
tccttgttgagaacaggaaagtggcca

SEQ ID NO: 730 - DNA, 27 bp, Artificial Sequence
  Synthetic oligonucleotide
tagccaggcaagtcatagaattgatta

SEQ ID NO: 731 - DNA, 27 bp, Artificial Sequence
  Synthetic oligonucleotide
ccaggcaagtcatagaattgattaccc

SEQ ID NO: 732 - DNA, 27 bp, Artificial Sequence
  Synthetic oligonucleotide
caggcaagtcatagaattgattacccg

SEQ ID NO: 733 - DNA, 27 bp, Artificial Sequence
  Synthetic oligonucleotide
tacccgccgaattcattaatttactgt

SEQ ID NO: 734 - DNA, 27 bp, Artificial Sequence
  Synthetic oligonucleotide
gccgaattcattaatttactgtagtgt

SEQ ID NO: 735 - DNA, 27 bp, Artificial Sequence
  Synthetic oligonucleotide
tagtgttaagagaagcactaagaatgc

SEQ ID NO: 736 - DNA, 27 bp, Artificial Sequence
  Synthetic oligonucleotide
gaagcactaagaatgccagtgacctgt

SEQ ID NO: 737 - DNA, 27 bp, Artificial Sequence
  Synthetic oligonucleotide
acaagtaatagaactatgactgtaagc

SEQ ID NO: 738 - DNA, 27 bp, Artificial Sequence
  Synthetic oligonucleotide
aagtaatagaactatgactgtaagcct

SEQ ID NO: 739 - DNA, 27 bp, Artificial Sequence
  Synthetic oligonucleotide
gcctcagtactgtacaagggaagcttt

SEQ ID NO: 740 - DNA, 27 bp, Artificial Sequence
  Synthetic oligonucleotide
tcccagtatacttcttagaaagtccaa

SEQ ID NO: 741 - DNA, 27 bp, Artificial Sequence
  Synthetic oligonucleotide
tacctgttatactttggcttggtttcc

SEQ ID NO: 742 - DNA, 27 bp, Artificial Sequence
  Synthetic oligonucleotide
agcctagtttatcaccaataatacttg

SEQ ID NO: 743 - DNA, 27 bp, Artificial Sequence
  Synthetic oligonucleotide
atcaccaataatacttgacggaaggct

SEQ ID NO: 744 - DNA, 27 bp, Artificial Sequence
  Synthetic oligonucleotide
tcaccaataatacttgacggaaggctc

SEQ ID NO: 745 - DNA, 27 bp, Artificial Sequence
  Synthetic oligonucleotide
caccaataatacttgacggaaggctca

SEQ ID NO: 746 - DNA, 27 bp, Artificial Sequence
  Synthetic oligonucleotide
aaggctcagtaattagttatgaatatg

SEQ ID NO: 747 - DNA, 27 bp, Artificial Sequence
  Synthetic oligonucleotide
ctcagtaattagttatgaatatggata

SEQ ID NO: 748 - DNA, 27 bp, Artificial Sequence
  Synthetic oligonucleotide
attcttaagacagcttgtaaatgtatt

SEQ ID NO: 749 - DNA, 27 bp, Artificial Sequence
  Synthetic oligonucleotide
tgtaaaaattgtatatatttttacaga

SEQ ID NO: 750 - DNA, 27 bp, Artificial Sequence
  Synthetic oligonucleotide
tttacagaaagtctatttctttgaaac

SEQ ID NO: 751 - DNA, 27 bp, Artificial Sequence
  Synthetic oligonucleotide
ttacagaaagtctatttctttgaaacg

SEQ ID NO: 752 - DNA, 27 bp, Artificial Sequence
  Synthetic oligonucleotide
tacagaaagtctatttctttgaaacga

SEQ ID NO: 753 - DNA, 27 bp, Artificial Sequence
  Synthetic oligonucleotide
acagaaagtctatttctttgaaacgaa

SEQ ID NO: 754 - DNA, 27 bp, Artificial Sequence
  Synthetic oligonucleotide
cagaaagtctatttctttgaaacgaag

SEQ ID NO: 755 - DNA, 27 bp, Artificial Sequence
  Synthetic oligonucleotide
aacgaaggaagtatcgaatttacatta

SEQ ID NO: 756 - DNA, 27 bp, Artificial Sequence
  Synthetic oligonucleotide
atcgaatttacattagtttttttcata

SEQ ID NO: 757 - DNA, 27 bp, Artificial Sequence
  Synthetic oligonucleotide
gaactttgcaacttccgtaattaggaa

SEQ ID NO: 758 - DNA, 27 bp, Artificial Sequence
  Synthetic oligonucleotide
agagtgtatacagaacgaattgatgtg

SEQ ID NO: 759 - DNA, 27 bp, Artificial Sequence
  Synthetic oligonucleotide
gtggaacaaatctgataactatgcagg

SEQ ID NO: 760 - DNA, 27 bp, Artificial Sequence
  Synthetic oligonucleotide
aaattttcttatctgattttggtaagt

SEQ ID NO: 761 - DNA, 27 bp, Artificial Sequence
  Synthetic oligonucleotide
taggtttttctttgaaaacctgggatt

SEQ ID NO: 762 - DNA, 27 bp, Artificial Sequence
  Synthetic oligonucleotide
ctgggattgagaggttgatgaatggaa

SEQ ID NO: 763 - DNA, 27 bp, Artificial Sequence
  Synthetic oligonucleotide
tgagaggttgatgaatggaaattcttt

SEQ ID NO: 764 - DNA, 27 bp, Artificial Sequence
  Synthetic oligonucleotide
aggttgatgaatggaaattctttcact

SEQ ID NO: 765 - DNA, 27 bp, Artificial Sequence
  Synthetic oligonucleotide
tatatgcaagttttcaataattaggtc

SEQ ID NO: 766 - DNA, 27 bp, Artificial Sequence
  Synthetic oligonucleotide
aaggttactgatgacttacaaataatg

SEQ ID NO: 767 - DNA, 27 bp, Artificial Sequence
  Synthetic oligonucleotide
attgggcaatactcatttgagttcctt

SEQ ID NO: 768 - DNA, 27 bp, Artificial Sequence
  Synthetic oligonucleotide
ttccatttgacctaatttaactggtga

SEQ ID NO: 769 - DNA, 27 bp, Artificial Sequence
  Synthetic oligonucleotide
ttaaagcttttactaaaagattttcag

SEQ ID NO: 770 - DNA, 27 bp, Artificial Sequence
  Synthetic oligonucleotide
caggtggatggagagacatttgatccc

SEQ ID NO: 771 - DNA, 27 bp, Artificial Sequence
  Synthetic oligonucleotide
tgcttaataaattataaaatgatggct

SEQ ID NO: 772 - DNA, 27 bp, Artificial Sequence
  Synthetic oligonucleotide
taaccatggtgctattattaggcttgc

SEQ ID NO: 773 - DNA, 27 bp, Artificial Sequence
  Synthetic oligonucleotide
taagcctagtatgtcaataaagcaaat

SEQ ID NO: 774 - DNA, 27 bp, Artificial Sequence
  Synthetic oligonucleotide
tactgttttgtttctattaatgattcc

SEQ ID NO: 775 - DNA, 27 bp, Artificial Sequence
  Synthetic oligonucleotide
ttctattaatgattcccaaaccttgtt

SEQ ID NO: 776 - DNA, 27 bp, Artificial Sequence
  Synthetic oligonucleotide
cttgttgcaagtttttgcattggcatc

SEQ ID NO: 777 - DNA, 27 bp, Artificial Sequence
  Synthetic oligonucleotide
ttggatttcagtcttgatgtttgttct

SEQ ID NO: 778 - DNA, 27 bp, Artificial Sequence
  Synthetic oligonucleotide
cttccttgaaattgctgattgttctgc

SEQ ID NO: 779 - DNA, 27 bp, Artificial Sequence
  Synthetic oligonucleotide
gctccctctacagatatttatatcaat

SEQ ID NO: 780 - DNA, 27 bp, Artificial Sequence
  Synthetic oligonucleotide
ccaccaagagtccacagacctttcatc

SEQ ID NO: 781 - DNA, 27 bp, Artificial Sequence
  Synthetic oligonucleotide
caccaagagtccacagacctttcatct

SEQ ID NO: 782 - DNA, 27 bp, Artificial Sequence
  Synthetic oligonucleotide
gagtccacagacctttcatctttcacg

SEQ ID NO: 783 - DNA, 27 bp, Artificial Sequence
  Synthetic oligonucleotide
agtccacagacctttcatctttcacga

SEQ ID NO: 784 - DNA, 27 bp, Artificial Sequence
  Synthetic oligonucleotide
gtccacagacctttcatctttcacgaa

SEQ ID NO: 785 - DNA, 27 bp, Artificial Sequence
  Synthetic oligonucleotide
tccacagacctttcatctttcacgaac

SEQ ID NO: 786 - DNA, 27 bp, Artificial Sequence
  Synthetic oligonucleotide
acagacctttcatctttcacgaacttg

SEQ ID NO: 787 - DNA, 27 bp, Artificial Sequence
  Synthetic oligonucleotide
gacctttcatctttcacgaacttgatc

SEQ ID NO: 788 - DNA, 27 bp, Artificial Sequence
  Synthetic oligonucleotide
ctgtgacactaacagtcattgagaggt

SEQ ID NO: 789 - DNA, 27 bp, Artificial Sequence
  Synthetic oligonucleotide
cactaacagtcattgagaggtgggagg

SEQ ID NO: 790 - DNA, 27 bp, Artificial Sequence
  Synthetic oligonucleotide
taggagtatgctcacttaaatttacag

SEQ ID NO: 791 - DNA, 27 bp, Artificial Sequence
  Synthetic oligonucleotide
gctcacttaaatttacagaaagaggtg

SEQ ID NO: 792 - DNA, 27 bp, Artificial Sequence
  Synthetic oligonucleotide
cacttaaatttacagaaagaggtgagc

SEQ ID NO: 793 - DNA, 27 bp, Artificial Sequence
  Synthetic oligonucleotide
aaactgaagaaagtgtctatattggaa

SEQ ID NO: 794 - DNA, 27 bp, Artificial Sequence
  Synthetic oligonucleotide
ttggaactagggtcatttgaaagcttc

SEQ ID NO: 795 - DNA, 27 bp, Artificial Sequence
  Synthetic oligonucleotide
aactagggtcatttgaaagcttcagtc

SEQ ID NO: 796 - DNA, 27 bp, Artificial Sequence
  Synthetic oligonucleotide
actagggtcatttgaaagcttcagtct

SEQ ID NO: 797 - DNA, 27 bp, Artificial Sequence
  Synthetic oligonucleotide
ctagggtcatttgaaagcttcagtctc

SEQ ID NO: 798 - DNA, 27 bp, Artificial Sequence
  Synthetic oligonucleotide
tagggtcatttgaaagcttcagtctcg

SEQ ID NO: 799 - DNA, 27 bp, Artificial Sequence
  Synthetic oligonucleotide
agggtcatttgaaagcttcagtctcgg

SEQ ID NO: 800 - DNA, 27 bp, Artificial Sequence
  Synthetic oligonucleotide
tcagtctcggaacatgacctttagtct

SEQ ID NO: 801 - DNA, 27 bp, Artificial Sequence
  Synthetic oligonucleotide
cggaacatgacctttagtctgtggact

SEQ ID NO: 802 - DNA, 27 bp, Artificial Sequence
  Synthetic oligonucleotide
gaacatgacctttagtctgtggactcc

SEQ ID NO: 803 - DNA, 27 bp, Artificial Sequence
  Synthetic oligonucleotide
tccatttaaaaataggtatgaataaga

SEQ ID NO: 804 - DNA, 27 bp, Artificial Sequence
  Synthetic oligonucleotide
taggtatgaataagatgactaagaatg

SEQ ID NO: 805 - DNA, 27 bp, Artificial Sequence
  Synthetic oligonucleotide
ctgcccatctcagagccataaggtcat

SEQ ID NO: 806 - DNA, 27 bp, Artificial Sequence
  Synthetic oligonucleotide
ttacctatgtatttatcgttcttgatc

SEQ ID NO: 807 - DNA, 27 bp, Artificial Sequence
  Synthetic oligonucleotide
aagccgcttatttatatcatgtatctc

SEQ ID NO: 808 - DNA, 27 bp, Artificial Sequence
  Synthetic oligonucleotide
atgtagtttttaattaatcttaagatc

SEQ ID NO: 809 - DNA, 27 bp, Artificial Sequence
  Synthetic oligonucleotide
agcctgtctgccaaatccagtggaaac

SEQ ID NO: 810 - DNA, 27 bp, Artificial Sequence
  Synthetic oligonucleotide
tctgccaaatccagtggaaacaagtgc

SEQ ID NO: 811 - DNA, 27 bp, Artificial Sequence
  Synthetic oligonucleotide
ccagtggaaacaagtgcatagatgtga

SEQ ID NO: 812 - DNA, 27 bp, Artificial Sequence
  Synthetic oligonucleotide
gtggaaacaagtgcatagatgtgaatt

SEQ ID NO: 813 - DNA, 27 bp, Artificial Sequence
  Synthetic oligonucleotide
ccacttcccaattcattaggtatgact

SEQ ID NO: 814 - DNA, 27 bp, Artificial Sequence
  Synthetic oligonucleotide
taggtatgactgtggaaatacagacaa

SEQ ID NO: 815 - DNA, 27 bp, Artificial Sequence
  Synthetic oligonucleotide
atgactgtggaaatacagacaaggatc

SEQ ID NO: 816 - DNA, 27 bp, Artificial Sequence
  Synthetic oligonucleotide
tgactgtggaaatacagacaaggatct

SEQ ID NO: 817 - DNA, 27 bp, Artificial Sequence
  Synthetic oligonucleotide
actgtggaaatacagacaaggatctta

SEQ ID NO: 818 - DNA, 27 bp, Artificial Sequence
  Synthetic oligonucleotide
ctgtggaaatacagacaaggatcttag

SEQ ID NO: 819 - DNA, 27 bp, Artificial Sequence
  Synthetic oligonucleotide
tgtggaaatacagacaaggatcttagt

SEQ ID NO: 820 - DNA, 27 bp, Artificial Sequence
  Synthetic oligonucleotide
gtggaaatacagacaaggatcttagtt

SEQ ID NO: 821 - DNA, 27 bp, Artificial Sequence
  Synthetic oligonucleotide
tggaaatacagacaaggatcttagttg

SEQ ID NO: 822 - DNA, 27 bp, Artificial Sequence
  Synthetic oligonucleotide
gaggaggaggcaggtggtctaagtgct

SEQ ID NO: 823 - DNA, 27 bp, Artificial Sequence
  Synthetic oligonucleotide
tggctacgtagttcgggcaaatcctcc

SEQ ID NO: 824 - DNA, 27 bp, Artificial Sequence
  Synthetic oligonucleotide
ggaggatttgcttagaaggatggcgct

SEQ ID NO: 825 - DNA, 27 bp, Artificial Sequence
  Synthetic oligonucleotide
gaggatttgcttagaaggatggcgctc

SEQ ID NO: 826 - DNA, 27 bp, Artificial Sequence
  Synthetic oligonucleotide
gtcctctagtgtttcatgtacattctg

SEQ ID NO: 827 - DNA, 27 bp, Artificial Sequence
  Synthetic oligonucleotide
gaacaccttggttctggttaaacagct

SEQ ID NO: 828 - DNA, 27 bp, Artificial Sequence
  Synthetic oligonucleotide
atagctgtgccaggaagggttaggacc

SEQ ID NO: 829 - DNA, 27 bp, Artificial Sequence
  Synthetic oligonucleotide
ccaggaagggttaggaccaactacaaa

SEQ ID NO: 830 - DNA, 27 bp, Artificial Sequence
  Synthetic oligonucleotide
agggttaggaccaactacaaattaatg

SEQ ID NO: 831 - DNA, 27 bp, Artificial Sequence
  Synthetic oligonucleotide
agggaacggccttcctcactcctgact

SEQ ID NO: 832 - DNA, 27 bp, Artificial Sequence
  Synthetic oligonucleotide
ctgcggagaaacgcggtcatcggcttg

SEQ ID NO: 833 - DNA, 27 bp, Artificial Sequence
  Synthetic oligonucleotide
ccggaggaggaactggacggctgcgag

SEQ ID NO: 834 - DNA, 27 bp, Artificial Sequence
  Synthetic oligonucleotide
cgaggaggaagaggacgacctataccg

SEQ ID NO: 835 - DNA, 27 bp, Artificial Sequence
  Synthetic oligonucleotide
gaggaggaagaggacgacctataccgc

SEQ ID NO: 836 - DNA, 27 bp, Artificial Sequence
  Synthetic oligonucleotide
aggaggaagaggacgacctataccgcc

SEQ ID NO: 837 - DNA, 27 bp, Artificial Sequence
  Synthetic oligonucleotide
gaggaagaggacgacctataccgccag

SEQ ID NO: 838 - DNA, 27 bp, Artificial Sequence
  Synthetic oligonucleotide
caggattgtgactcttatttctttcgg

SEQ ID NO: 839 - DNA, 27 bp, Artificial Sequence
  Synthetic oligonucleotide
tgtggccaaacacttaaagagcgtaaa

SEQ ID NO: 840 - DNA, 27 bp, Artificial Sequence
  Synthetic oligonucleotide
gtggccaaacacttaaagagcgtaaac

SEQ ID NO: 841 - DNA, 27 bp, Artificial Sequence
  Synthetic oligonucleotide
tggccaaacacttaaagagcgtaaacc

SEQ ID NO: 842 - DNA, 27 bp, Artificial Sequence
  Synthetic oligonucleotide
aaagagcgtaaaccaagaaagcttcat

SEQ ID NO: 843 - DNA, 27 bp, Artificial Sequence
  Synthetic oligonucleotide
cgaaccattagcagaaactatcacaga

SEQ ID NO: 844 - DNA, 27 bp, Artificial Sequence
  Synthetic oligonucleotide
ttagcagaaactatcacagatgttctt

SEQ ID NO: 845 - DNA, 27 bp, Artificial Sequence
  Synthetic oligonucleotide
acgggactggcttgtcaaacaaagagg

SEQ ID NO: 846 - DNA, 27 bp, Artificial Sequence
  Synthetic oligonucleotide
cgggactggcttgtcaaacaaagaggc

SEQ ID NO: 847 - DNA, 27 bp, Artificial Sequence
  Synthetic oligonucleotide
ttgtggagttcttccacgtacaggacc

SEQ ID NO: 848 - DNA, 27 bp, Artificial Sequence
  Synthetic oligonucleotide
ggagttcttccacgtacaggacctaga

SEQ ID NO: 849 - DNA, 27 bp, Artificial Sequence
  Synthetic oligonucleotide
ttccacgtacaggacctagaaggcggc

SEQ ID NO: 850 - DNA, 27 bp, Artificial Sequence
  Synthetic oligonucleotide
ctggtctggcatatctaataagatagc

SEQ ID NO: 851 - DNA, 27 bp, Artificial Sequence
  Synthetic oligonucleotide
agccaccaaactacatgcatctgtgaa

SEQ ID NO: 852 - DNA, 27 bp, Artificial Sequence
  Synthetic oligonucleotide
catgtgtatttatgaaggtggacttga

SEQ ID NO: 853 - DNA, 27 bp, Artificial Sequence
  Synthetic oligonucleotide
tgtgtatttatgaaggtggacttgaag

SEQ ID NO: 854 - DNA, 27 bp, Artificial Sequence
  Synthetic oligonucleotide
gtatttatgaaggtggacttgaagctg

SEQ ID NO: 855 - DNA, 27 bp, Artificial Sequence
  Synthetic oligonucleotide
gtccagttctactgtagcaacatagca

SEQ ID NO: 856 - DNA, 27 bp, Artificial Sequence
  Synthetic oligonucleotide
ccctggaagagtcactgtctgaatgaa

SEQ ID NO: 857 - DNA, 27 bp, Artificial Sequence
  Synthetic oligonucleotide
cctggaagagtcactgtctgaatgaag

SEQ ID NO: 858 - DNA, 27 bp, Artificial Sequence
  Synthetic oligonucleotide
ctggaagagtcactgtctgaatgaagc

SEQ ID NO: 859 - DNA, 27 bp, Artificial Sequence
  Synthetic oligonucleotide
cactgtctgaatgaagcaaagttccct

SEQ ID NO: 860 - DNA, 27 bp, Artificial Sequence
  Synthetic oligonucleotide
ttccctctcagcaaacactgagaggcc

SEQ ID NO: 861 - DNA, 27 bp, Artificial Sequence
  Synthetic oligonucleotide
tccctctcagcaaacactgagaggcca

SEQ ID NO: 862 - DNA, 27 bp, Artificial Sequence
  Synthetic oligonucleotide
tcagcaaacactgagaggccatggaga

SEQ ID NO: 863 - DNA, 27 bp, Artificial Sequence
  Synthetic oligonucleotide
aacactgagaggccatggagaaggact

SEQ ID NO: 864 - DNA, 27 bp, Artificial Sequence
  Synthetic oligonucleotide
gaggccatggagaaggacttctagaat

SEQ ID NO: 865 - DNA, 27 bp, Artificial Sequence
  Synthetic oligonucleotide
aggccatggagaaggacttctagaatg

SEQ ID NO: 866 - DNA, 27 bp, Artificial Sequence
  Synthetic oligonucleotide
tggagaaggacttctagaatgaatgaa

SEQ ID NO: 867 - DNA, 27 bp, Artificial Sequence
  Synthetic oligonucleotide
gaaggacttctagaatgaatgaaaggg

SEQ ID NO: 868 - DNA, 27 bp, Artificial Sequence
  Synthetic oligonucleotide
gtggatggaaaggtttgatttcctatc

SEQ ID NO: 869 - DNA, 27 bp, Artificial Sequence
  Synthetic oligonucleotide
ccagtcatcaggctagtcacaaagctc

SEQ ID NO: 870 - DNA, 27 bp, Artificial Sequence
  Synthetic oligonucleotide
cagtcatcaggctagtcacaaagctca

SEQ ID NO: 871 - DNA, 27 bp, Artificial Sequence
  Synthetic oligonucleotide
aggctagtcacaaagctcaataaatat

SEQ ID NO: 872 - DNA, 27 bp, Artificial Sequence
  Synthetic oligonucleotide
aagccctaattaacaacgttggtgact

SEQ ID NO: 873 - DNA, 27 bp, Artificial Sequence
  Synthetic oligonucleotide
aacctacaagtcaccaaacgatgacta

SEQ ID NO: 874 - DNA, 27 bp, Artificial Sequence
  Synthetic oligonucleotide
acctacaagtcaccaaacgatgactag

SEQ ID NO: 875 - DNA, 27 bp, Artificial Sequence
  Synthetic oligonucleotide
agtcaccaaacgatgactagaagctgc

SEQ ID NO: 876 - DNA, 27 bp, Artificial Sequence
  Synthetic oligonucleotide
gtcaccaaacgatgactagaagctgca

SEQ ID NO: 877 - DNA, 27 bp, Artificial Sequence
  Synthetic oligonucleotide
tcaccaaacgatgactagaagctgcag

SEQ ID NO: 878 - DNA, 27 bp, Artificial Sequence
  Synthetic oligonucleotide
caccaaacgatgactagaagctgcagt

SEQ ID NO: 879 - DNA, 27 bp, Artificial Sequence
  Synthetic oligonucleotide
caggaatgtgaagggaggcctctgagc

SEQ ID NO: 880 - DNA, 27 bp, Artificial Sequence
  Synthetic oligonucleotide
tgtgcttgacaaagtcccaagtgctca

SEQ ID NO: 881 - DNA, 27 bp, Artificial Sequence
  Synthetic oligonucleotide
gtgcttgacaaagtcccaagtgctcag

SEQ ID NO: 882 - DNA, 27 bp, Artificial Sequence
  Synthetic oligonucleotide
ttgacaaagtcccaagtgctcaggact

SEQ ID NO: 883 - DNA, 27 bp, Artificial Sequence
  Synthetic oligonucleotide
agccctgtctactttggcttggtttgg

SEQ ID NO: 884 - DNA, 27 bp, Artificial Sequence
  Synthetic oligonucleotide
ttcttaagtttattagcctagtgatgg

SEQ ID NO: 885 - DNA, 27 bp, Artificial Sequence
  Synthetic oligonucleotide
aaagtacttgacttaaggttcactaat

SEQ ID NO: 886 - DNA, 27 bp, Artificial Sequence
  Synthetic oligonucleotide
gaacataagagggaagtcttggattta

SEQ ID NO: 887 - DNA, 27 bp, Artificial Sequence
  Synthetic oligonucleotide
cagcttctctagttagaaatgtatttc

SEQ ID NO: 888 - DNA, 27 bp, Artificial Sequence
  Synthetic oligonucleotide
tgtcatccgttctagtgtatatgcaga

SEQ ID NO: 889 - DNA, 27 bp, Artificial Sequence
  Synthetic oligonucleotide
tgtgtgtggactggttatagatttata

SEQ ID NO: 890 - DNA, 27 bp, Artificial Sequence
  Synthetic oligonucleotide
taactatgcagggttaattatccaatc

SEQ ID NO: 891 - DNA, 27 bp, Artificial Sequence
  Synthetic oligonucleotide
atcacaggtagatagatgtaagacatt

SEQ ID NO: 892 - DNA, 27 bp, Artificial Sequence
  Synthetic oligonucleotide
aggtagatagatgtaagacatttgatc

SEQ ID NO: 893 - DNA, 27 bp, Artificial Sequence
  Synthetic oligonucleotide
gtaaatggtaaagcaggctagagtctt

SEQ ID NO: 894 - DNA, 27 bp, Artificial Sequence
  Synthetic oligonucleotide
atggtgctattcactgggtttacttgt

SEQ ID NO: 895 - DNA, 27 bp, Artificial Sequence
  Synthetic oligonucleotide
tttcttgtctactaaggattgccaagc

SEQ ID NO: 896 - DNA, 27 bp, Artificial Sequence
  Synthetic oligonucleotide
tggtctctaggtgtagcctttacttcc

SEQ ID NO: 897 - DNA, 27 bp, Artificial Sequence
  Synthetic oligonucleotide
ccctatagagtcgtctacacttcctcc

SEQ ID NO: 898 - DNA, 27 bp, Artificial Sequence
  Synthetic oligonucleotide
gtcgtctacacttcctccctgtgctct

SEQ ID NO: 899 - DNA, 27 bp, Artificial Sequence
  Synthetic oligonucleotide
tagttatctgcattagaactctcaccc

SEQ ID NO: 900 - DNA, 27 bp, Artificial Sequence
  Synthetic oligonucleotide
atcctaatcagagtcagcacagctttc

SEQ ID NO: 901 - DNA, 27 bp, Artificial Sequence
  Synthetic oligonucleotide
acagctttcctgtcagaggataggaac

SEQ ID NO: 902 - DNA, 27 bp, Artificial Sequence
  Synthetic oligonucleotide
ttcctgtcagaggataggaacacttgc

SEQ ID NO: 903 - DNA, 27 bp, Artificial Sequence
  Synthetic oligonucleotide
ctgtcagaggataggaacacttgctct

SEQ ID NO: 904 - DNA, 27 bp, Artificial Sequence
  Synthetic oligonucleotide
tgtcagaggataggaacacttgctctt

SEQ ID NO: 905 - DNA, 27 bp, Artificial Sequence
  Synthetic oligonucleotide
gaccgacagtgaccagggattggcatt

SEQ ID NO: 906 - DNA, 27 bp, Artificial Sequence
  Synthetic oligonucleotide
catgctttccattgttactttgtctat

SEQ ID NO: 907 - DNA, 27 bp, Artificial Sequence
  Synthetic oligonucleotide
aaggttggaaattatacgtttatactt

SEQ ID NO: 908 - DNA, 27 bp, Artificial Sequence
  Synthetic oligonucleotide
ttattagtttgctccaagtatgactgt

SEQ ID NO: 909 - DNA, 27 bp, Artificial Sequence
  Synthetic oligonucleotide
ttcacttaagtttagagaaacactggg

SEQ ID NO: 910 - DNA, 27 bp, Artificial Sequence
  Synthetic oligonucleotide
ccactggtaactgaaggtatttaagct

SEQ ID NO: 911 - DNA, 27 bp, Artificial Sequence
  Synthetic oligonucleotide
cagcctcagaatgtgacctttagtcag

SEQ ID NO: 912 - DNA, 27 bp, Artificial Sequence
  Synthetic oligonucleotide
aataggcaggaatcaaatgactaagaa

SEQ ID NO: 913 - DNA, 27 bp, Artificial Sequence
  Synthetic oligonucleotide
ataggcaggaatcaaatgactaagaat

SEQ ID NO: 914 - DNA, 27 bp, Artificial Sequence
  Synthetic oligonucleotide
taggcaggaatcaaatgactaagaatg

SEQ ID NO: 915 - DNA, 27 bp, Artificial Sequence
  Synthetic oligonucleotide
aggcaggaatcaaatgactaagaatgt

SEQ ID NO: 916 - DNA, 27 bp, Artificial Sequence
  Synthetic oligonucleotide
ggcaggaatcaaatgactaagaatgta

SEQ ID NO: 917 - DNA, 27 bp, Artificial Sequence
  Synthetic oligonucleotide
gcaggaatcaaatgactaagaatgtaa

SEQ ID NO: 918 - DNA, 27 bp, Artificial Sequence
  Synthetic oligonucleotide
caggaatcaaatgactaagaatgtaat

SEQ ID NO: 919 - DNA, 27 bp, Artificial Sequence
  Synthetic oligonucleotide
aggaatcaaatgactaagaatgtaata

SEQ ID NO: 920 - DNA, 27 bp, Artificial Sequence
  Synthetic oligonucleotide
atgactaagaatgtaatagggaagaag

SEQ ID NO: 921 - DNA, 27 bp, Artificial Sequence
  Synthetic oligonucleotide
ctgccagcttgggagtgatttgtacct

SEQ ID NO: 922 - DNA, 27 bp, Artificial Sequence
  Synthetic oligonucleotide
atccttgatcatagtttgcttatttat

SEQ ID NO: 923 - DNA, 27 bp, Artificial Sequence
  Synthetic oligonucleotide
agagcactttatgtagttgaataaacc

SEQ ID NO: 924 - DNA, 27 bp, Artificial Sequence
  Synthetic oligonucleotide
gagcactttatgtagttgaataaaccc

SEQ ID NO: 925 - DNA, 27 bp, Artificial Sequence
  Synthetic oligonucleotide
tttgtttactaggagcctgacttccca

SEQ ID NO: 926 - DNA, 27 bp, Artificial Sequence
  Synthetic oligonucleotide
agcctgacttcccagctcacaaagggt

SEQ ID NO: 927 - DNA, 27 bp, Artificial Sequence
  Synthetic oligonucleotide
gcctgacttcccagctcacaaagggtg

SEQ ID NO: 928 - DNA, 27 bp, Artificial Sequence
  Synthetic oligonucleotide
cctgacttcccagctcacaaagggtga

SEQ ID NO: 929 - DNA, 27 bp, Artificial Sequence
  Synthetic oligonucleotide
tcccagctcacaaagggtgaaatgaaa

SEQ ID NO: 930 - DNA, 27 bp, Artificial Sequence
  Synthetic oligonucleotide
agctcacaaagggtgaaatgaaagctg

SEQ ID NO: 931 - DNA, 27 bp, Artificial Sequence
  Synthetic oligonucleotide
gctgaagtacagacaggatcttagtag

SEQ ID NO: 932 - DNA, 27 bp, Artificial Sequence
  Synthetic oligonucleotide
gaagtacagacaggatcttagtaggta

SEQ ID NO: 933 - DNA, 27 bp, Artificial Sequence
  Synthetic oligonucleotide
gggccatgaagacttggagagcgcagt

SEQ ID NO: 934 - DNA, 27 bp, Artificial Sequence
  Synthetic oligonucleotide
ctttggagggaagaagcatgtggtctg

SEQ ID NO: 935 - DNA, 27 bp, Artificial Sequence
  Synthetic oligonucleotide
tgagtgctgactagatgaatagttgag

SEQ ID NO: 936 - DNA, 27 bp, Artificial Sequence
  Synthetic oligonucleotide
gctgactagatgaatagttgaggcaca

SEQ ID NO: 937 - DNA, 27 bp, Artificial Sequence
  Synthetic oligonucleotide
tgaggcacatccttcagagaagaggga

SEQ ID NO: 938 - DNA, 27 bp, Artificial Sequence
  Synthetic oligonucleotide
gaggcacatccttcagagaagagggag

SEQ ID NO: 939 - DNA, 27 bp, Artificial Sequence
  Synthetic oligonucleotide
gggctgcttggaaagatggctctcagc

SEQ ID NO: 940 - DNA, 27 bp, Artificial Sequence
  Synthetic oligonucleotide
aatctgtttgtcttacacgtctctcag

SEQ ID NO: 941 - DNA, 27 bp, Artificial Sequence
  Synthetic oligonucleotide
caagcatcttccatgtacattctatct

SEQ ID NO: 942 - DNA, 27 bp, Artificial Sequence
  Synthetic oligonucleotide
gagcacctaacactttaacagctgttc

SEQ ID NO: 943 - DNA, 27 bp, Artificial Sequence
  Synthetic oligonucleotide
acagctgttcccgaaagggttaggacc

SEQ ID NO: 944 - DNA, 27 bp, Artificial Sequence
  Synthetic oligonucleotide
cccgaaagggttaggaccaactgcaag

SEQ ID NO: 945 - DNA, 27 bp, Artificial Sequence
  Synthetic oligonucleotide
gaccaactgcaagttaatgtgggttgt

SEQ ID NO: 946 - RNA, 25 nt, Artificial Sequence
  Synthetic oligonucleotide
gccacuucucacuuccgcuuccuuc

SEQ ID NO: 947 - RNA, 25 nt, Artificial Sequence
  Synthetic oligonucleotide
acuucucacuuccgcuuccuuccag

SEQ ID NO: 948 - RNA, 25 nt, Artificial Sequence
  Synthetic oligonucleotide
ggcggcgacuggcaauguuuggccu

SEQ ID NO: 949 - RNA, 25 nt, Artificial Sequence
  Synthetic oligonucleotide
cgcgguaaucggacucaaccucuac

SEQ ID NO: 950 - RNA, 25 nt, Artificial Sequence
  Synthetic oligonucleotide
agggcgacuuuuggcuacggagaag

SEQ ID NO: 951 - RNA, 25 nt, Artificial Sequence
  Synthetic oligonucleotide
gcgaggcugcuuuucuucgcgccca

SEQ ID NO: 952 - RNA, 25 nt, Artificial Sequence
  Synthetic oligonucleotide
ugguaauaacaccaguacggacggg

SEQ ID NO: 953 - RNA, 25 nt, Artificial Sequence
  Synthetic oligonucleotide
ggaggaggacgaguuguaccggcag

SEQ ID NO: 954 - RNA, 25 nt, Artificial Sequence
  Synthetic oligonucleotide
cggcagucgcuggagauuaucucuc

SEQ ID NO: 955 - RNA, 25 nt, Artificial Sequence
  Synthetic oligonucleotide
caaggacacaaagccaaugggcagg

SEQ ID NO: 956 - RNA, 25 nt, Artificial Sequence
  Synthetic oligonucleotide
ggaaggcgcuggagaccuuacgacg

SEQ ID NO: 957 - RNA, 25 nt, Artificial Sequence
  Synthetic oligonucleotide
ggcgugcagcgcaaccacgagacgg

SEQ ID NO: 958 - RNA, 25 nt, Artificial Sequence
  Synthetic oligonucleotide
gcgugcagcgcaaccacgagacggc

SEQ ID NO: 959 - RNA, 25 nt, Artificial Sequence
  Synthetic oligonucleotide
cgugcagcgcaaccacgagacggcc

SEQ ID NO: 960 - RNA, 25 nt, Artificial Sequence
  Synthetic oligonucleotide
gugcagcgcaaccacgagacggccu

SEQ ID NO: 961 - RNA, 25 nt, Artificial Sequence
  Synthetic oligonucleotide
ugcagcgcaaccacgagacggccuu

SEQ ID NO: 962 - RNA, 25 nt, Artificial Sequence
  Synthetic oligonucleotide
gcagcgcaaccacgagacggccuuc

SEQ ID NO: 963 - RNA, 25 nt, Artificial Sequence
  Synthetic oligonucleotide
cagcgcaaccacgagacggccuucc

SEQ ID NO: 964 - RNA, 25 nt, Artificial Sequence
  Synthetic oligonucleotide
agcgcaaccacgagacggccuucca

SEQ ID NO: 965 - RNA, 25 nt, Artificial Sequence
  Synthetic oligonucleotide
gcgcaaccacgagacggccuuccaa

SEQ ID NO: 966 - RNA, 25 nt, Artificial Sequence
  Synthetic oligonucleotide
cgcaaccacgagacggccuuccaag

SEQ ID NO: 967 - RNA, 25 nt, Artificial Sequence
  Synthetic oligonucleotide
gcaaccacgagacggccuuccaagg

SEQ ID NO: 968 - RNA, 25 nt, Artificial Sequence
  Synthetic oligonucleotide
caaccacgagacggccuuccaaggc

SEQ ID NO: 969 - RNA, 25 nt, Artificial Sequence
  Synthetic oligonucleotide
aaccacgagacggccuuccaaggca

SEQ ID NO: 970 - RNA, 25 nt, Artificial Sequence
  Synthetic oligonucleotide
accacgagacggccuuccaaggcau

SEQ ID NO: 971 - RNA, 25 nt, Artificial Sequence
  Synthetic oligonucleotide
ccaaggcaugcuucggaaacuggac

SEQ ID NO: 972 - RNA, 25 nt, Artificial Sequence
  Synthetic oligonucleotide
caaggcaugcuucggaaacuggaca

SEQ ID NO: 973 - RNA, 25 nt, Artificial Sequence
  Synthetic oligonucleotide
cgaagacgaugugaaaucguugucu

SEQ ID NO: 974 - RNA, 25 nt, Artificial Sequence
  Synthetic oligonucleotide
cgaugugaaaucguugucucgagug

SEQ ID NO: 975 - RNA, 25 nt, Artificial Sequence
  Synthetic oligonucleotide
gcaggauugugacucucauuucuuu

SEQ ID NO: 976 - RNA, 25 nt, Artificial Sequence
  Synthetic oligonucleotide
gugacucucauuucuuuuggugccu

SEQ ID NO: 977 - RNA, 25 nt, Artificial Sequence
  Synthetic oligonucleotide
cuuuguggcuaaacacuugaagacc

SEQ ID NO: 978 - RNA, 25 nt, Artificial Sequence
  Synthetic oligonucleotide
uggcuaaacacuugaagaccauaaa

SEQ ID NO: 979 - RNA, 25 nt, Artificial Sequence
  Synthetic oligonucleotide
ggcuaaacacuugaagaccauaaac

SEQ ID NO: 980 - RNA, 25 nt, Artificial Sequence
  Synthetic oligonucleotide
gcuaaacacuugaagaccauaaacc

SEQ ID NO: 981 - RNA, 25 nt, Artificial Sequence
  Synthetic oligonucleotide
cuaaacacuugaagaccauaaacca

SEQ ID NO: 982 - RNA, 25 nt, Artificial Sequence
  Synthetic oligonucleotide
acuugaagaccauaaaccaagaaag

SEQ ID NO: 983 - RNA, 25 nt, Artificial Sequence
  Synthetic oligonucleotide
cuugaagaccauaaaccaagaaagc

SEQ ID NO: 984 - RNA, 25 nt, Artificial Sequence
  Synthetic oligonucleotide
agaccauaaaccaagaaagcugcau

SEQ ID NO: 985 - RNA, 25 nt, Artificial Sequence
  Synthetic oligonucleotide
caucgaaccauuagcagaaaguauc

SEQ ID NO: 986 - RNA, 25 nt, Artificial Sequence
  Synthetic oligonucleotide
aucgaaccauuagcagaaaguauca

SEQ ID NO: 987 - RNA, 25 nt, Artificial Sequence
  Synthetic oligonucleotide
accauuagcagaaaguaucacagac

SEQ ID NO: 988 - RNA, 25 nt, Artificial Sequence
  Synthetic oligonucleotide
gggacuggcuaguuaaacaaagagg

SEQ ID NO: 989 - RNA, 25 nt, Artificial Sequence
  Synthetic oligonucleotide
ggacuggcuaguuaaacaaagaggc

SEQ ID NO: 990 - RNA, 25 nt, Artificial Sequence
  Synthetic oligonucleotide
cuaguuaaacaaagaggcugggaug

SEQ ID NO: 991 - RNA, 25 nt, Artificial Sequence
  Synthetic oligonucleotide
aaacaaagaggcugggauggguuug

SEQ ID NO: 992 - RNA, 25 nt, Artificial Sequence
  Synthetic oligonucleotide
aacaaagaggcugggauggguuugu

SEQ ID NO: 993 - RNA, 25 nt, Artificial Sequence
  Synthetic oligonucleotide
acaaagaggcugggauggguuugug

SEQ ID NO: 994 - RNA, 25 nt, Artificial Sequence
  Synthetic oligonucleotide
caaagaggcugggauggguuugugg

SEQ ID NO: 995 - RNA, 25 nt, Artificial Sequence
  Synthetic oligonucleotide
aaagaggcugggauggguuugugga

SEQ ID NO: 996 - RNA, 25 nt, Artificial Sequence
  Synthetic oligonucleotide
aagaggcugggauggguuuguggag

SEQ ID NO: 997 - RNA, 25 nt, Artificial Sequence
  Synthetic oligonucleotide
agaggcugggauggguuuguggagu

SEQ ID NO: 998 - RNA, 25 nt, Artificial Sequence
  Synthetic oligonucleotide
gaggcugggauggguuuguggaguu

SEQ ID NO: 999 - RNA, 25 nt, Artificial Sequence
  Synthetic oligonucleotide
aggcugggauggguuuguggaguuc

SEQ ID NO: 1000 - RNA, 25 nt, Artificial Sequence
  Synthetic oligonucleotide
ggcugggauggguuuguggaguucu

SEQ ID NO: 1001 - RNA, 25 nt, Artificial Sequence
  Synthetic oligonucleotide
gcugggauggguuuguggaguucuu

SEQ ID NO: 1002 - RNA, 25 nt, Artificial Sequence
  Synthetic oligonucleotide
cugggauggguuuguggaguucuuc

SEQ ID NO: 1003 - RNA, 25 nt, Artificial Sequence
  Synthetic oligonucleotide
ugggauggguuuguggaguucuucc

SEQ ID NO: 1004 - RNA, 25 nt, Artificial Sequence
  Synthetic oligonucleotide
gggauggguuuguggaguucuucca

SEQ ID NO: 1005 - RNA, 25 nt, Artificial Sequence
  Synthetic oligonucleotide
ggauggguuuguggaguucuuccau

SEQ ID NO: 1006 - RNA, 25 nt, Artificial Sequence
  Synthetic oligonucleotide
gauggguuuguggaguucuuccaug

SEQ ID NO: 1007 - RNA, 25 nt, Artificial Sequence
  Synthetic oligonucleotide
auggguuuguggaguucuuccaugu

SEQ ID NO: 1008 - RNA, 25 nt, Artificial Sequence
  Synthetic oligonucleotide
uggguuuguggaguucuuccaugua

SEQ ID NO: 1009 - RNA, 25 nt, Artificial Sequence
  Synthetic oligonucleotide
ggguuuguggaguucuuccauguag

SEQ ID NO: 1010 - RNA, 25 nt, Artificial Sequence
  Synthetic oligonucleotide
gguuuguggaguucuuccauguaga

SEQ ID NO: 1011 - RNA, 25 nt, Artificial Sequence
  Synthetic oligonucleotide
aguucuuccauguagaggaccuaga

SEQ ID NO: 1012 - RNA, 25 nt, Artificial Sequence
  Synthetic oligonucleotide
ccauguagaggaccuagaagguggc

SEQ ID NO: 1013 - RNA, 25 nt, Artificial Sequence
  Synthetic oligonucleotide
ggaccuagaagguggcaucaggaau

SEQ ID NO: 1014 - RNA, 25 nt, Artificial Sequence
  Synthetic oligonucleotide
gguguugcuggaguaggagcugguu

SEQ ID NO: 1015 - RNA, 25 nt, Artificial Sequence
  Synthetic oligonucleotide
cugguuuggcauaucuaauaagaua

SEQ ID NO: 1016 - RNA, 25 nt, Artificial Sequence
  Synthetic oligonucleotide
uggcauaucuaauaagauagccuua

SEQ ID NO: 1017 - RNA, 25 nt, Artificial Sequence
  Synthetic oligonucleotide
ggcauaucuaauaagauagccuuac

SEQ ID NO: 1018 - RNA, 25 nt, Artificial Sequence
  Synthetic oligonucleotide
gcauaucuaauaagauagccuuacu

SEQ ID NO: 1019 - RNA, 25 nt, Artificial Sequence
  Synthetic oligonucleotide
cauaucuaauaagauagccuuacug

SEQ ID NO: 1020 - RNA, 25 nt, Artificial Sequence
  Synthetic oligonucleotide
auaucuaauaagauagccuuacugu

SEQ ID NO: 1021 - RNA, 25 nt, Artificial Sequence
  Synthetic oligonucleotide
uaucuaauaagauagccuuacugua

SEQ ID NO: 1022 - RNA, 25 nt, Artificial Sequence
  Synthetic oligonucleotide
gccuuacuguaagugcaauaguuga

SEQ ID NO: 1023 - RNA, 25 nt, Artificial Sequence
  Synthetic oligonucleotide
ggacuccaagcuguaacuuccuaga

SEQ ID NO: 1024 - RNA, 25 nt, Artificial Sequence
  Synthetic oligonucleotide
uuccuagaguugcacccuagcaacc

SEQ ID NO: 1025 - RNA, 25 nt, Artificial Sequence
  Synthetic oligonucleotide
gcaaguggcaagaggauuauggcua

SEQ ID NO: 1026 - RNA, 25 nt, Artificial Sequence
  Synthetic oligonucleotide
uggcaagaggauuauggcuaacaag

SEQ ID NO: 1027 - RNA, 25 nt, Artificial Sequence
  Synthetic oligonucleotide
ggcaagaggauuauggcuaacaaga

SEQ ID NO: 1028 - RNA, 25 nt, Artificial Sequence
  Synthetic oligonucleotide
gaggauuauggcuaacaagaauaaa

SEQ ID NO: 1029 - RNA, 25 nt, Artificial Sequence
  Synthetic oligonucleotide
uggcuaacaagaauaaauacauggg

SEQ ID NO: 1030 - RNA, 25 nt, Artificial Sequence
  Synthetic oligonucleotide
ggcuaacaagaauaaauacauggga

SEQ ID NO: 1031 - RNA, 25 nt, Artificial Sequence
  Synthetic oligonucleotide
gcuaacaagaauaaauacaugggaa

SEQ ID NO: 1032 - RNA, 25 nt, Artificial Sequence
  Synthetic oligonucleotide
cuaacaagaauaaauacaugggaag

SEQ ID NO: 1033 - RNA, 25 nt, Artificial Sequence
  Synthetic oligonucleotide
uaacaagaauaaauacaugggaaga

SEQ ID NO: 1034 - RNA, 25 nt, Artificial Sequence
  Synthetic oligonucleotide
aacaagaauaaauacaugggaagag

SEQ ID NO: 1035 - RNA, 25 nt, Artificial Sequence
  Synthetic oligonucleotide
acaagaauaaauacaugggaagagu

SEQ ID NO: 1036 - RNA, 25 nt, Artificial Sequence
  Synthetic oligonucleotide
caagaauaaauacaugggaagagug

SEQ ID NO: 1037 - RNA, 25 nt, Artificial Sequence
  Synthetic oligonucleotide
aagaauaaauacaugggaagagugc

SEQ ID NO: 1038 - RNA, 25 nt, Artificial Sequence
  Synthetic oligonucleotide
agaauaaauacaugggaagagugcu

SEQ ID NO: 1039 - RNA, 25 nt, Artificial Sequence
  Synthetic oligonucleotide
cauugauugaagagucacugucuga

SEQ ID NO: 1040 - RNA, 25 nt, Artificial Sequence
  Synthetic oligonucleotide
cugucugaaagaagcaaaguucagu

SEQ ID NO: 1041 - RNA, 25 nt, Artificial Sequence
  Synthetic oligonucleotide
acaaacuuuguuugggaagcuaugg

SEQ ID NO: 1042 - RNA, 25 nt, Artificial Sequence
  Synthetic oligonucleotide
aggacuuuuagauuuagugaagaug

SEQ ID NO: 1043 - RNA, 25 nt, Artificial Sequence
  Synthetic oligonucleotide
agaugguaggguggaaagacuuaau

SEQ ID NO: 1044 - RNA, 25 nt, Artificial Sequence
  Synthetic oligonucleotide
cuuguugagaacaggaaaguggcca

SEQ ID NO: 1045 - RNA, 25 nt, Artificial Sequence
  Synthetic oligonucleotide
gccaggcaagucauagaauugauua

SEQ ID NO: 1046 - RNA, 25 nt, Artificial Sequence
  Synthetic oligonucleotide
aggcaagucauagaauugauuaccc

SEQ ID NO: 1047 - RNA, 25 nt, Artificial Sequence
  Synthetic oligonucleotide
ggcaagucauagaauugauuacccg

SEQ ID NO: 1048 - RNA, 25 nt, Artificial Sequence
  Synthetic oligonucleotide
cccgccgaauucauuaauuuacugu

SEQ ID NO: 1049 - RNA, 25 nt, Artificial Sequence
  Synthetic oligonucleotide
cgaauucauuaauuuacuguagugu

SEQ ID NO: 1050 - RNA, 25 nt, Artificial Sequence
  Synthetic oligonucleotide
guguuaagagaagcacuaagaaugc

SEQ ID NO: 1051 - RNA, 25 nt, Artificial Sequence
  Synthetic oligonucleotide
agcacuaagaaugccagugaccugu

SEQ ID NO: 1052 - RNA, 25 nt, Artificial Sequence
  Synthetic oligonucleotide
aaguaauagaacuaugacuguaagc

SEQ ID NO: 1053 - RNA, 25 nt, Artificial Sequence
  Synthetic oligonucleotide
guaauagaacuaugacuguaagccu

SEQ ID NO: 1054 - RNA, 25 nt, Artificial Sequence
  Synthetic oligonucleotide
cucaguacuguacaagggaagcuuu

SEQ ID NO: 1055 - RNA, 25 nt, Artificial Sequence
  Synthetic oligonucleotide
ccaguauacuucuuagaaaguccaa

SEQ ID NO: 1056 - RNA, 25 nt, Artificial Sequence
  Synthetic oligonucleotide
ccuguuauacuuuggcuugguuucc

SEQ ID NO: 1057 - RNA, 25 nt, Artificial Sequence
  Synthetic oligonucleotide
ccuaguuuaucaccaauaauacuug

SEQ ID NO: 1058 - RNA, 25 nt, Artificial Sequence
  Synthetic oligonucleotide
caccaauaauacuugacggaaggcu

SEQ ID NO: 1059 - RNA, 25 nt, Artificial Sequence
  Synthetic oligonucleotide
accaauaauacuugacggaaggcuc

SEQ ID NO: 1060 - RNA, 25 nt, Artificial Sequence
  Synthetic oligonucleotide
ccaauaauacuugacggaaggcuca

SEQ ID NO: 1061 - RNA, 25 nt, Artificial Sequence
  Synthetic oligonucleotide
ggcucaguaauuaguuaugaauaug

SEQ ID NO: 1062 - RNA, 25 nt, Artificial Sequence
  Synthetic oligonucleotide
caguaauuaguuaugaauauggaua

SEQ ID NO: 1063 - RNA, 25 nt, Artificial Sequence
  Synthetic oligonucleotide
ucuuaagacagcuuguaaauguauu

SEQ ID NO: 1064 - RNA, 25 nt, Artificial Sequence
  Synthetic oligonucleotide
uaaaaauuguauauauuuuuacaga

SEQ ID NO: 1065 - RNA, 25 nt, Artificial Sequence
  Synthetic oligonucleotide
uacagaaagucuauuucuuugaaac

SEQ ID NO: 1066 - RNA, 25 nt, Artificial Sequence
  Synthetic oligonucleotide
acagaaagucuauuucuuugaaacg

SEQ ID NO: 1067 - RNA, 25 nt, Artificial Sequence
  Synthetic oligonucleotide
cagaaagucuauuucuuugaaacga

SEQ ID NO: 1068 - RNA, 25 nt, Artificial Sequence
  Synthetic oligonucleotide
agaaagucuauuucuuugaaacgaa

SEQ ID NO: 1069 - RNA, 25 nt, Artificial Sequence
  Synthetic oligonucleotide
gaaagucuauuucuuugaaacgaag

SEQ ID NO: 1070 - RNA, 25 nt, Artificial Sequence
  Synthetic oligonucleotide
cgaaggaaguaucgaauuuacauua

SEQ ID NO: 1071 - RNA, 25 nt, Artificial Sequence
  Synthetic oligonucleotide
cgaauuuacauuaguuuuuuucaua

SEQ ID NO: 1072 - RNA, 25 nt, Artificial Sequence
  Synthetic oligonucleotide
acuuugcaacuuccguaauuaggaa

SEQ ID NO: 1073 - RNA, 25 nt, Artificial Sequence
  Synthetic oligonucleotide
aguguauacagaacgaauugaugug

SEQ ID NO: 1074 - RNA, 25 nt, Artificial Sequence
  Synthetic oligonucleotide
ggaacaaaucugauaacuaugcagg

SEQ ID NO: 1075 - RNA, 25 nt, Artificial Sequence
  Synthetic oligonucleotide
auuuucuuaucugauuuugguaagu

SEQ ID NO: 1076 - RNA, 25 nt, Artificial Sequence
  Synthetic oligonucleotide
gguuuuucuuugaaaaccugggauu

SEQ ID NO: 1077 - RNA, 25 nt, Artificial Sequence
  Synthetic oligonucleotide
gggauugagagguugaugaauggaa

SEQ ID NO: 1078 - RNA, 25 nt, Artificial Sequence
  Synthetic oligonucleotide
agagguugaugaauggaaauucuuu

SEQ ID NO: 1079 - RNA, 25 nt, Artificial Sequence
  Synthetic oligonucleotide
guugaugaauggaaauucuuucacu

SEQ ID NO: 1080 - RNA, 25 nt, Artificial Sequence
  Synthetic oligonucleotide
uaugcaaguuuucaauaauuagguc

SEQ ID NO: 1081 - RNA, 25 nt, Artificial Sequence
  Synthetic oligonucleotide
gguuacugaugacuuacaaauaaug

SEQ ID NO: 1082 - RNA, 25 nt, Artificial Sequence
  Synthetic oligonucleotide
ugggcaauacucauuugaguuccuu

SEQ ID NO: 1083 - RNA, 25 nt, Artificial Sequence
  Synthetic oligonucleotide
ccauuugaccuaauuuaacugguga

SEQ ID NO: 1084 - RNA, 25 nt, Artificial Sequence
  Synthetic oligonucleotide
aaagcuuuuacuaaaagauuuucag

SEQ ID NO: 1085 - RNA, 25 nt, Artificial Sequence
  Synthetic oligonucleotide
gguggauggagagacauuugauccc

SEQ ID NO: 1086 - RNA, 25 nt, Artificial Sequence
  Synthetic oligonucleotide
cuuaauaaauuauaaaaugauggcu

SEQ ID NO: 1087 - RNA, 25 nt, Artificial Sequence
  Synthetic oligonucleotide
accauggugcuauuauuaggcuugc

SEQ ID NO: 1088 - RNA, 25 nt, Artificial Sequence
  Synthetic oligonucleotide
agccuaguaugucaauaaagcaaau

SEQ ID NO: 1089 - RNA, 25 nt, Artificial Sequence
  Synthetic oligonucleotide
cuguuuuguuucuauuaaugauucc

SEQ ID NO: 1090 - RNA, 25 nt, Artificial Sequence
  Synthetic oligonucleotide
cuauuaaugauucccaaaccuuguu

SEQ ID NO: 1091 - RNA, 25 nt, Artificial Sequence
  Synthetic oligonucleotide
uguugcaaguuuuugcauuggcauc

SEQ ID NO: 1092 - RNA, 25 nt, Artificial Sequence
  Synthetic oligonucleotide
ggauuucagucuugauguuuguucu

SEQ ID NO: 1093 - RNA, 25 nt, Artificial Sequence
  Synthetic oligonucleotide
uccuugaaauugcugauuguucugc

SEQ ID NO: 1094 - RNA, 25 nt, Artificial Sequence
  Synthetic oligonucleotide
ucccucuacagauauuuauaucaau

SEQ ID NO: 1095 - RNA, 25 nt, Artificial Sequence
  Synthetic oligonucleotide
accaagaguccacagaccuuucauc

SEQ ID NO: 1096 - RNA, 25 nt, Artificial Sequence
  Synthetic oligonucleotide
ccaagaguccacagaccuuucaucu

SEQ ID NO: 1097 - RNA, 25 nt, Artificial Sequence
  Synthetic oligonucleotide
guccacagaccuuucaucuuucacg

SEQ ID NO: 1098 - RNA, 25 nt, Artificial Sequence
  Synthetic oligonucleotide
uccacagaccuuucaucuuucacga

SEQ ID NO: 1099 - RNA, 25 nt, Artificial Sequence
  Synthetic oligonucleotide
ccacagaccuuucaucuuucacgaa

SEQ ID NO: 1100 - RNA, 25 nt, Artificial Sequence
  Synthetic oligonucleotide
cacagaccuuucaucuuucacgaac

SEQ ID NO: 1101 - RNA, 25 nt, Artificial Sequence
  Synthetic oligonucleotide
agaccuuucaucuuucacgaacuug

SEQ ID NO: 1102 - RNA, 25 nt, Artificial Sequence
  Synthetic oligonucleotide
ccuuucaucuuucacgaacuugauc

SEQ ID NO: 1103 - RNA, 25 nt, Artificial Sequence
  Synthetic oligonucleotide
gugacacuaacagucauugagaggu

SEQ ID NO: 1104 - RNA, 25 nt, Artificial Sequence
  Synthetic oligonucleotide
cuaacagucauugagaggugggagg

SEQ ID NO: 1105 - RNA, 25 nt, Artificial Sequence
  Synthetic oligonucleotide
ggaguaugcucacuuaaauuuacag

SEQ ID NO: 1106 - RNA, 25 nt, Artificial Sequence
  Synthetic oligonucleotide
ucacuuaaauuuacagaaagaggug

SEQ ID NO: 1107 - RNA, 25 nt, Artificial Sequence
  Synthetic oligonucleotide
cuuaaauuuacagaaagaggugagc

SEQ ID NO: 1108 - RNA, 25 nt, Artificial Sequence
  Synthetic oligonucleotide
acugaagaaagugucuauauuggaa

SEQ ID NO: 1109 - RNA, 25 nt, Artificial Sequence
  Synthetic oligonucleotide
ggaacuagggucauuugaaagcuuc

SEQ ID NO: 1110 - RNA, 25 nt, Artificial Sequence
  Synthetic oligonucleotide
cuagggucauuugaaagcuucaguc

SEQ ID NO: 1111 - RNA, 25 nt, Artificial Sequence
  Synthetic oligonucleotide
uagggucauuugaaagcuucagucu

SEQ ID NO: 1112 - RNA, 25 nt, Artificial Sequence
  Synthetic oligonucleotide
agggucauuugaaagcuucagucuc

SEQ ID NO: 1113 - RNA, 25 nt, Artificial Sequence
  Synthetic oligonucleotide
gggucauuugaaagcuucagucucg

SEQ ID NO: 1114 - RNA, 25 nt, Artificial Sequence
  Synthetic oligonucleotide
ggucauuugaaagcuucagucucgg

SEQ ID NO: 1115 - RNA, 25 nt, Artificial Sequence
  Synthetic oligonucleotide
agucucggaacaugaccuuuagucu

SEQ ID NO: 1116 - RNA, 25 nt, Artificial Sequence
  Synthetic oligonucleotide
gaacaugaccuuuagucuguggacu

SEQ ID NO: 1117 - RNA, 25 nt, Artificial Sequence
  Synthetic oligonucleotide
acaugaccuuuagucuguggacucc

SEQ ID NO: 1118 - RNA, 25 nt, Artificial Sequence
  Synthetic oligonucleotide
cauuuaaaaauagguaugaauaaga

SEQ ID NO: 1119 - RNA, 25 nt, Artificial Sequence
  Synthetic oligonucleotide
gguaugaauaagaugacuaagaaug

SEQ ID NO: 1120 - RNA, 25 nt, Artificial Sequence
  Synthetic oligonucleotide
gcccaucucagagccauaaggucau

SEQ ID NO: 1121 - RNA, 25 nt, Artificial Sequence
  Synthetic oligonucleotide
accuauguauuuaucguucuugauc

SEQ ID NO: 1122 - RNA, 25 nt, Artificial Sequence
  Synthetic oligonucleotide
gccgcuuauuuauaucauguaucuc

SEQ ID NO: 1123 - RNA, 25 nt, Artificial Sequence
  Synthetic oligonucleotide
guaguuuuuaauuaaucuuaagauc

SEQ ID NO: 1124 - RNA, 25 nt, Artificial Sequence
  Synthetic oligonucleotide
ccugucugccaaauccaguggaaac

SEQ ID NO: 1125 - RNA, 25 nt, Artificial Sequence
  Synthetic oligonucleotide
ugccaaauccaguggaaacaagugc

SEQ ID NO: 1126 - RNA, 25 nt, Artificial Sequence
  Synthetic oligonucleotide
aguggaaacaagugcauagauguga

SEQ ID NO: 1127 - RNA, 25 nt, Artificial Sequence
  Synthetic oligonucleotide
ggaaacaagugcauagaugugaauu

SEQ ID NO: 1128 - RNA, 25 nt, Artificial Sequence
  Synthetic oligonucleotide
acuucccaauucauuagguaugacu

SEQ ID NO: 1129 - RNA, 25 nt, Artificial Sequence
  Synthetic oligonucleotide
gguaugacuguggaaauacagacaa

SEQ ID NO: 1130 - RNA, 25 nt, Artificial Sequence
  Synthetic oligonucleotide
gacuguggaaauacagacaaggauc

SEQ ID NO: 1131 - RNA, 25 nt, Artificial Sequence
  Synthetic oligonucleotide
acuguggaaauacagacaaggaucu

SEQ ID NO: 1132 - RNA, 25 nt, Artificial Sequence
  Synthetic oligonucleotide
uguggaaauacagacaaggaucuua

SEQ ID NO: 1133 - RNA, 25 nt, Artificial Sequence
  Synthetic oligonucleotide
guggaaauacagacaaggaucuuag

SEQ ID NO: 1134 - RNA, 25 nt, Artificial Sequence
  Synthetic oligonucleotide
uggaaauacagacaaggaucuuagu

SEQ ID NO: 1135 - RNA, 25 nt, Artificial Sequence
  Synthetic oligonucleotide
ggaaauacagacaaggaucuuaguu

SEQ ID NO: 1136 - RNA, 25 nt, Artificial Sequence
  Synthetic oligonucleotide
gaaauacagacaaggaucuuaguug

SEQ ID NO: 1137 - RNA, 25 nt, Artificial Sequence
  Synthetic oligonucleotide
ggaggaggcagguggucuaagugcu

SEQ ID NO: 1138 - RNA, 25 nt, Artificial Sequence
  Synthetic oligonucleotide
gcuacguaguucgggcaaauccucc

SEQ ID NO: 1139 - RNA, 25 nt, Artificial Sequence
  Synthetic oligonucleotide
aggauuugcuuagaaggauggcgcu

SEQ ID NO: 1140 - RNA, 25 nt, Artificial Sequence
  Synthetic oligonucleotide
ggauuugcuuagaaggauggcgcuc

SEQ ID NO: 1141 - RNA, 25 nt, Artificial Sequence
  Synthetic oligonucleotide
ccucuaguguuucauguacauucug

SEQ ID NO: 1142 - RNA, 25 nt, Artificial Sequence
  Synthetic oligonucleotide
acaccuugguucugguuaaacagcu

SEQ ID NO: 1143 - RNA, 25 nt, Artificial Sequence
  Synthetic oligonucleotide
agcugugccaggaaggguuaggacc

SEQ ID NO: 1144 - RNA, 25 nt, Artificial Sequence
  Synthetic oligonucleotide
aggaaggguuaggaccaacuacaaa

SEQ ID NO: 1145 - RNA, 25 nt, Artificial Sequence
  Synthetic oligonucleotide
gguuaggaccaacuacaaauuaaug

SEQ ID NO: 1146 - RNA, 25 nt, Artificial Sequence
  Synthetic oligonucleotide
ggaacggccuuccucacuccugacu

SEQ ID NO: 1147 - RNA, 25 nt, Artificial Sequence
  Synthetic oligonucleotide
gcggagaaacgcggucaucggcuug

SEQ ID NO: 1148 - RNA, 25 nt, Artificial Sequence
  Synthetic oligonucleotide
ggaggaggaacuggacggcugcgag

SEQ ID NO: 1149 - RNA, 25 nt, Artificial Sequence
  Synthetic oligonucleotide
aggaggaagaggacgaccuauaccg

SEQ ID NO: 1150 - RNA, 25 nt, Artificial Sequence
  Synthetic oligonucleotide
ggaggaagaggacgaccuauaccgc

SEQ ID NO: 1151 - RNA, 25 nt, Artificial Sequence
  Synthetic oligonucleotide
gaggaagaggacgaccuauaccgcc

SEQ ID NO: 1152 - RNA, 25 nt, Artificial Sequence
  Synthetic oligonucleotide
ggaagaggacgaccuauaccgccag

SEQ ID NO: 1153 - RNA, 25 nt, Artificial Sequence
  Synthetic oligonucleotide
ggauugugacucuuauuucuuucgg

SEQ ID NO: 1154 - RNA, 25 nt, Artificial Sequence
  Synthetic oligonucleotide
uggccaaacacuuaaagagcguaaa

SEQ ID NO: 1155 - RNA, 25 nt, Artificial Sequence
  Synthetic oligonucleotide
ggccaaacacuuaaagagcguaaac

SEQ ID NO: 1156 - RNA, 25 nt, Artificial Sequence
  Synthetic oligonucleotide
gccaaacacuuaaagagcguaaacc

SEQ ID NO: 1157 - RNA, 25 nt, Artificial Sequence
  Synthetic oligonucleotide
agagcguaaaccaagaaagcuucau

SEQ ID NO: 1158 - RNA, 25 nt, Artificial Sequence
  Synthetic oligonucleotide
aaccauuagcagaaacuaucacaga

SEQ ID NO: 1159 - RNA, 25 nt, Artificial Sequence
  Synthetic oligonucleotide
agcagaaacuaucacagauguucuu

SEQ ID NO: 1160 - RNA, 25 nt, Artificial Sequence
  Synthetic oligonucleotide
gggacuggcuugucaaacaaagagg

SEQ ID NO: 1161 - RNA, 25 nt, Artificial Sequence
  Synthetic oligonucleotide
ggacuggcuugucaaacaaagaggc

SEQ ID NO: 1162 - RNA, 25 nt, Artificial Sequence
  Synthetic oligonucleotide
guggaguucuuccacguacaggacc

SEQ ID NO: 1163 - RNA, 25 nt, Artificial Sequence
  Synthetic oligonucleotide
aguucuuccacguacaggaccuaga

SEQ ID NO: 1164 - RNA, 25 nt, Artificial Sequence
  Synthetic oligonucleotide
ccacguacaggaccuagaaggcggc

SEQ ID NO: 1165 - RNA, 25 nt, Artificial Sequence
  Synthetic oligonucleotide
ggucuggcauaucuaauaagauagc

SEQ ID NO: 1166 - RNA, 25 nt, Artificial Sequence
  Synthetic oligonucleotide
ccaccaaacuacaugcaucugugaa

SEQ ID NO: 1167 - RNA, 25 nt, Artificial Sequence
  Synthetic oligonucleotide
uguguauuuaugaagguggacuuga

SEQ ID NO: 1168 - RNA, 25 nt, Artificial Sequence
  Synthetic oligonucleotide
uguauuuaugaagguggacuugaag

SEQ ID NO: 1169 - RNA, 25 nt, Artificial Sequence
  Synthetic oligonucleotide
auuuaugaagguggacuugaagcug

SEQ ID NO: 1170 - RNA, 25 nt, Artificial Sequence
  Synthetic oligonucleotide
ccaguucuacuguagcaacauagca

SEQ ID NO: 1171 - RNA, 25 nt, Artificial Sequence
  Synthetic oligonucleotide
cuggaagagucacugucugaaugaa

SEQ ID NO: 1172 - RNA, 25 nt, Artificial Sequence
  Synthetic oligonucleotide
uggaagagucacugucugaaugaag

SEQ ID NO: 1173 - RNA, 25 nt, Artificial Sequence
  Synthetic oligonucleotide
ggaagagucacugucugaaugaagc

SEQ ID NO: 1174 - RNA, 25 nt, Artificial Sequence
  Synthetic oligonucleotide
cugucugaaugaagcaaaguucccu

SEQ ID NO: 1175 - RNA, 25 nt, Artificial Sequence
  Synthetic oligonucleotide
cccucucagcaaacacugagaggcc

SEQ ID NO: 1176 - RNA, 25 nt, Artificial Sequence
  Synthetic oligonucleotide
ccucucagcaaacacugagaggcca

SEQ ID NO: 1177 - RNA, 25 nt, Artificial Sequence
  Synthetic oligonucleotide
agcaaacacugagaggccauggaga

SEQ ID NO: 1178 - RNA, 25 nt, Artificial Sequence
  Synthetic oligonucleotide
cacugagaggccauggagaaggacu

SEQ ID NO: 1179 - RNA, 25 nt, Artificial Sequence
  Synthetic oligonucleotide
ggccauggagaaggacuucuagaau

SEQ ID NO: 1180 - RNA, 25 nt, Artificial Sequence
  Synthetic oligonucleotide
gccauggagaaggacuucuagaaug

SEQ ID NO: 1181 - RNA, 25 nt, Artificial Sequence
  Synthetic oligonucleotide
gagaaggacuucuagaaugaaugaa

SEQ ID NO: 1182 - RNA, 25 nt, Artificial Sequence
  Synthetic oligonucleotide
aggacuucuagaaugaaugaaaggg

SEQ ID NO: 1183 - RNA, 25 nt, Artificial Sequence
  Synthetic oligonucleotide
ggauggaaagguuugauuuccuauc

SEQ ID NO: 1184 - RNA, 25 nt, Artificial Sequence
  Synthetic oligonucleotide
agucaucaggcuagucacaaagcuc

SEQ ID NO: 1185 - RNA, 25 nt, Artificial Sequence
  Synthetic oligonucleotide
gucaucaggcuagucacaaagcuca

SEQ ID NO: 1186 - RNA, 25 nt, Artificial Sequence
  Synthetic oligonucleotide
gcuagucacaaagcucaauaaauau

SEQ ID NO: 1187 - RNA, 25 nt, Artificial Sequence
  Synthetic oligonucleotide
gcccuaauuaacaacguuggugacu

SEQ ID NO: 1188 - RNA, 25 nt, Artificial Sequence
  Synthetic oligonucleotide
ccuacaagucaccaaacgaugacua

SEQ ID NO: 1189 - RNA, 25 nt, Artificial Sequence
  Synthetic oligonucleotide
cuacaagucaccaaacgaugacuag

SEQ ID NO: 1190 - RNA, 25 nt, Artificial Sequence
  Synthetic oligonucleotide
ucaccaaacgaugacuagaagcugc

SEQ ID NO: 1191 - RNA, 25 nt, Artificial Sequence
  Synthetic oligonucleotide
caccaaacgaugacuagaagcugca

SEQ ID NO: 1192 - RNA, 25 nt, Artificial Sequence
  Synthetic oligonucleotide
accaaacgaugacuagaagcugcag

SEQ ID NO: 1193 - RNA, 25 nt, Artificial Sequence
  Synthetic oligonucleotide
ccaaacgaugacuagaagcugcagu

SEQ ID NO: 1194 - RNA, 25 nt, Artificial Sequence
  Synthetic oligonucleotide
ggaaugugaagggaggccucugagc

SEQ ID NO: 1195 - RNA, 25 nt, Artificial Sequence
  Synthetic oligonucleotide
ugcuugacaaagucccaagugcuca

SEQ ID NO: 1196 - RNA, 25 nt, Artificial Sequence
  Synthetic oligonucleotide
gcuugacaaagucccaagugcucag

SEQ ID NO: 1197 - RNA, 25 nt, Artificial Sequence
  Synthetic oligonucleotide
gacaaagucccaagugcucaggacu

SEQ ID NO: 1198 - RNA, 25 nt, Artificial Sequence
  Synthetic oligonucleotide
cccugucuacuuuggcuugguuugg

SEQ ID NO: 1199 - RNA, 25 nt, Artificial Sequence
  Synthetic oligonucleotide
cuuaaguuuauuagccuagugaugg

SEQ ID NO: 1200 - RNA, 25 nt, Artificial Sequence
  Synthetic oligonucleotide
aguacuugacuuaagguucacuaau

SEQ ID NO: 1201 - RNA, 25 nt, Artificial Sequence
  Synthetic oligonucleotide
acauaagagggaagucuuggauuua

SEQ ID NO: 1202 - RNA, 25 nt, Artificial Sequence
  Synthetic oligonucleotide
gcuucucuaguuagaaauguauuuc

SEQ ID NO: 1203 - RNA, 25 nt, Artificial Sequence
  Synthetic oligonucleotide
ucauccguucuaguguauaugcaga

SEQ ID NO: 1204 - RNA, 25 nt, Artificial Sequence
  Synthetic oligonucleotide
uguguggacugguuauagauuuaua

SEQ ID NO: 1205 - RNA, 25 nt, Artificial Sequence
  Synthetic oligonucleotide
acuaugcaggguuaauuauccaauc

SEQ ID NO: 1206 - RNA, 25 nt, Artificial Sequence
  Synthetic oligonucleotide
cacagguagauagauguaagacauu

SEQ ID NO: 1207 - RNA, 25 nt, Artificial Sequence
  Synthetic oligonucleotide
guagauagauguaagacauuugauc

SEQ ID NO: 1208 - RNA, 25 nt, Artificial Sequence
  Synthetic oligonucleotide
aaaugguaaagcaggcuagagucuu

SEQ ID NO: 1209 - RNA, 25 nt, Artificial Sequence
  Synthetic oligonucleotide
ggugcuauucacuggguuuacuugu

SEQ ID NO: 1210 - RNA, 25 nt, Artificial Sequence
  Synthetic oligonucleotide
ucuugucuacuaaggauugccaagc

SEQ ID NO: 1211 - RNA, 25 nt, Artificial Sequence
  Synthetic oligonucleotide
gucucuagguguagccuuuacuucc

SEQ ID NO: 1212 - RNA, 25 nt, Artificial Sequence
  Synthetic oligonucleotide
cuauagagucgucuacacuuccucc

SEQ ID NO: 1213 - RNA, 25 nt, Artificial Sequence
  Synthetic oligonucleotide
cgucuacacuuccucccugugcucu

SEQ ID NO: 1214 - RNA, 25 nt, Artificial Sequence
  Synthetic oligonucleotide
guuaucugcauuagaacucucaccc

SEQ ID NO: 1215 - RNA, 25 nt, Artificial Sequence
  Synthetic oligonucleotide
ccuaaucagagucagcacagcuuuc

SEQ ID NO: 1216 - RNA, 25 nt, Artificial Sequence
  Synthetic oligonucleotide
agcuuuccugucagaggauaggaac

SEQ ID NO: 1217 - RNA, 25 nt, Artificial Sequence
  Synthetic oligonucleotide
ccugucagaggauaggaacacuugc

SEQ ID NO: 1218 - RNA, 25 nt, Artificial Sequence
  Synthetic oligonucleotide
gucagaggauaggaacacuugcucu

SEQ ID NO: 1219 - RNA, 25 nt, Artificial Sequence
  Synthetic oligonucleotide
ucagaggauaggaacacuugcucuu

SEQ ID NO: 1220 - RNA, 25 nt, Artificial Sequence
  Synthetic oligonucleotide
ccgacagugaccagggauuggcauu

SEQ ID NO: 1221 - RNA, 25 nt, Artificial Sequence
  Synthetic oligonucleotide
ugcuuuccauuguuacuuugucuau

SEQ ID NO: 1222 - RNA, 25 nt, Artificial Sequence
  Synthetic oligonucleotide
gguuggaaauuauacguuuauacuu

SEQ ID NO: 1223 - RNA, 25 nt, Artificial Sequence
  Synthetic oligonucleotide
auuaguuugcuccaaguaugacugu

SEQ ID NO: 1224 - RNA, 25 nt, Artificial Sequence
  Synthetic oligonucleotide
cacuuaaguuuagagaaacacuggg

SEQ ID NO: 1225 - RNA, 25 nt, Artificial Sequence
  Synthetic oligonucleotide
acugguaacugaagguauuuaagcu

SEQ ID NO: 1226 - RNA, 25 nt, Artificial Sequence
  Synthetic oligonucleotide
gccucagaaugugaccuuuagucag

SEQ ID NO: 1227 - RNA, 25 nt, Artificial Sequence
  Synthetic oligonucleotide
uaggcaggaaucaaaugacuaagaa

SEQ ID NO: 1228 - RNA, 25 nt, Artificial Sequence
  Synthetic oligonucleotide
aggcaggaaucaaaugacuaagaau

SEQ ID NO: 1229 - RNA, 25 nt, Artificial Sequence
  Synthetic oligonucleotide
ggcaggaaucaaaugacuaagaaug

SEQ ID NO: 1230 - RNA, 25 nt, Artificial Sequence
  Synthetic oligonucleotide
gcaggaaucaaaugacuaagaaugu

SEQ ID NO: 1231 - RNA, 25 nt, Artificial Sequence
  Synthetic oligonucleotide
caggaaucaaaugacuaagaaugua

SEQ ID NO: 1232 - RNA, 25 nt, Artificial Sequence
  Synthetic oligonucleotide
aggaaucaaaugacuaagaauguaa

SEQ ID NO: 1233 - RNA, 25 nt, Artificial Sequence
  Synthetic oligonucleotide
ggaaucaaaugacuaagaauguaau

SEQ ID NO: 1234 - RNA, 25 nt, Artificial Sequence
  Synthetic oligonucleotide
gaaucaaaugacuaagaauguaaua

SEQ ID NO: 1235 - RNA, 25 nt, Artificial Sequence
  Synthetic oligonucleotide
gacuaagaauguaauagggaagaag

SEQ ID NO: 1236 - RNA, 25 nt, Artificial Sequence
  Synthetic oligonucleotide
gccagcuugggagugauuuguaccu

SEQ ID NO: 1237 - RNA, 25 nt, Artificial Sequence
  Synthetic oligonucleotide
ccuugaucauaguuugcuuauuuau

SEQ ID NO: 1238 - RNA, 25 nt, Artificial Sequence
  Synthetic oligonucleotide
agcacuuuauguaguugaauaaacc

SEQ ID NO: 1239 - RNA, 25 nt, Artificial Sequence
  Synthetic oligonucleotide
gcacuuuauguaguugaauaaaccc

SEQ ID NO: 1240 - RNA, 25 nt, Artificial Sequence
  Synthetic oligonucleotide
uguuuacuaggagccugacuuccca

SEQ ID NO: 1241 - RNA, 25 nt, Artificial Sequence
  Synthetic oligonucleotide
ccugacuucccagcucacaaagggu

SEQ ID NO: 1242 - RNA, 25 nt, Artificial Sequence
  Synthetic oligonucleotide
cugacuucccagcucacaaagggug

SEQ ID NO: 1243 - RNA, 25 nt, Artificial Sequence
  Synthetic oligonucleotide
ugacuucccagcucacaaaggguga

SEQ ID NO: 1244 - RNA, 25 nt, Artificial Sequence
  Synthetic oligonucleotide
ccagcucacaaagggugaaaugaaa

SEQ ID NO: 1245 - RNA, 25 nt, Artificial Sequence
  Synthetic oligonucleotide
cucacaaagggugaaaugaaagcug

SEQ ID NO: 1246 - RNA, 25 nt, Artificial Sequence
  Synthetic oligonucleotide
ugaaguacagacaggaucuuaguag

SEQ ID NO: 1247 - RNA, 25 nt, Artificial Sequence
  Synthetic oligonucleotide
aguacagacaggaucuuaguaggua

SEQ ID NO: 1248 - RNA, 25 nt, Artificial Sequence
  Synthetic oligonucleotide
gccaugaagacuuggagagcgcagu

SEQ ID NO: 1249 - RNA, 25 nt, Artificial Sequence
  Synthetic oligonucleotide
uuggagggaagaagcauguggucug

SEQ ID NO: 1250 - RNA, 25 nt, Artificial Sequence
  Synthetic oligonucleotide
agugcugacuagaugaauaguugag

SEQ ID NO: 1251 - RNA, 25 nt, Artificial Sequence
  Synthetic oligonucleotide
ugacuagaugaauaguugaggcaca

SEQ ID NO: 1252 - RNA, 25 nt, Artificial Sequence
  Synthetic oligonucleotide
aggcacauccuucagagaagaggga

SEQ ID NO: 1253 - RNA, 25 nt, Artificial Sequence
  Synthetic oligonucleotide
ggcacauccuucagagaagagggag

SEQ ID NO: 1254 - RNA, 25 nt, Artificial Sequence
  Synthetic oligonucleotide
gcugcuuggaaagauggcucucagc

SEQ ID NO: 1255 - RNA, 25 nt, Artificial Sequence
  Synthetic oligonucleotide
ucuguuugucuuacacgucucucag

SEQ ID NO: 1256 - RNA, 25 nt, Artificial Sequence
  Synthetic oligonucleotide
agcaucuuccauguacauucuaucu

SEQ ID NO: 1257 - RNA, 25 nt, Artificial Sequence
  Synthetic oligonucleotide
gcaccuaacacuuuaacagcuguuc

SEQ ID NO: 1258 - RNA, 25 nt, Artificial Sequence
  Synthetic oligonucleotide
agcuguucccgaaaggguuaggacc

SEQ ID NO: 1259 - RNA, 25 nt, Artificial Sequence
  Synthetic oligonucleotide
cgaaaggguuaggaccaacugcaag

SEQ ID NO: 1260 - RNA, 25 nt, Artificial Sequence
  Synthetic oligonucleotide
ccaacugcaaguuaauguggguugu

SEQ ID NO: 1261 - RNA, 21 nt, Artificial Sequence
  Synthetic oligonucleotide
ucgccacuucucacuuccgcu

SEQ ID NO: 1262 - RNA, 21 nt, Artificial Sequence
  Synthetic oligonucleotide
ccacuucucacuuccgcuucc

SEQ ID NO: 1263 - RNA, 21 nt, Artificial Sequence
  Synthetic oligonucleotide
gcggcggcgacuggcaauguu

SEQ ID NO: 1264 - RNA, 21 nt, Artificial Sequence
  Synthetic oligonucleotide
aacgcgguaaucggacucaac

SEQ ID NO: 1265 - RNA, 21 nt, Artificial Sequence
  Synthetic oligonucleotide
ggagggcgacuuuuggcuacg

SEQ ID NO: 1266 - RNA, 21 nt, Artificial Sequence
  Synthetic oligonucleotide
ccgcgaggcugcuuuucuucg

SEQ ID NO: 1267 - RNA, 21 nt, Artificial Sequence
  Synthetic oligonucleotide
ucugguaauaacaccaguacg

SEQ ID NO: 1268 - RNA, 21 nt, Artificial Sequence
  Synthetic oligonucleotide
gaggaggaggacgaguuguac

SEQ ID NO: 1269 - RNA, 21 nt, Artificial Sequence
  Synthetic oligonucleotide
accggcagucgcuggagauua

SEQ ID NO: 1270 - RNA, 21 nt, Artificial Sequence
  Synthetic oligonucleotide
gccaaggacacaaagccaaug

SEQ ID NO: 1271 - RNA, 21 nt, Artificial Sequence
  Synthetic oligonucleotide
caggaaggcgcuggagaccuu

SEQ ID NO: 1272 - RNA, 21 nt, Artificial Sequence
  Synthetic oligonucleotide
auggcgugcagcgcaaccacg

SEQ ID NO: 1273 - RNA, 21 nt, Artificial Sequence
  Synthetic oligonucleotide
uggcgugcagcgcaaccacga

SEQ ID NO: 1274 - RNA, 21 nt, Artificial Sequence
  Synthetic oligonucleotide
ggcgugcagcgcaaccacgag

SEQ ID NO: 1275 - RNA, 21 nt, Artificial Sequence
  Synthetic oligonucleotide
gcgugcagcgcaaccacgaga

SEQ ID NO: 1276 - RNA, 21 nt, Artificial Sequence
  Synthetic oligonucleotide
cgugcagcgcaaccacgagac

SEQ ID NO: 1277 - RNA, 21 nt, Artificial Sequence
  Synthetic oligonucleotide
gugcagcgcaaccacgagacg

SEQ ID NO: 1278 - RNA, 21 nt, Artificial Sequence
  Synthetic oligonucleotide
ugcagcgcaaccacgagacgg

SEQ ID NO: 1279 - RNA, 21 nt, Artificial Sequence
  Synthetic oligonucleotide
gcagcgcaaccacgagacggc

SEQ ID NO: 1280 - RNA, 21 nt, Artificial Sequence
  Synthetic oligonucleotide
cagcgcaaccacgagacggcc

SEQ ID NO: 1281 - RNA, 21 nt, Artificial Sequence
  Synthetic oligonucleotide
agcgcaaccacgagacggccu

SEQ ID NO: 1282 - RNA, 21 nt, Artificial Sequence
  Synthetic oligonucleotide
gcgcaaccacgagacggccuu

SEQ ID NO: 1283 - RNA, 21 nt, Artificial Sequence
  Synthetic oligonucleotide
cgcaaccacgagacggccuuc

SEQ ID NO: 1284 - RNA, 21 nt, Artificial Sequence
  Synthetic oligonucleotide
gcaaccacgagacggccuucc

SEQ ID NO: 1285 - RNA, 21 nt, Artificial Sequence
  Synthetic oligonucleotide
caaccacgagacggccuucca

SEQ ID NO: 1286 - RNA, 21 nt, Artificial Sequence
  Synthetic oligonucleotide
uuccaaggcaugcuucggaaa

SEQ ID NO: 1287 - RNA, 21 nt, Artificial Sequence
  Synthetic oligonucleotide
uccaaggcaugcuucggaaac

SEQ ID NO: 1288 - RNA, 21 nt, Artificial Sequence
  Synthetic oligonucleotide
aacgaagacgaugugaaaucg

SEQ ID NO: 1289 - RNA, 21 nt, Artificial Sequence
  Synthetic oligonucleotide
gacgaugugaaaucguugucu

SEQ ID NO: 1290 - RNA, 21 nt, Artificial Sequence
  Synthetic oligonucleotide
gggcaggauugugacucucau

SEQ ID NO: 1291 - RNA, 21 nt, Artificial Sequence
  Synthetic oligonucleotide
uugugacucucauuucuuuug

SEQ ID NO: 1292 - RNA, 21 nt, Artificial Sequence
  Synthetic oligonucleotide
gccuuuguggcuaaacacuug

SEQ ID NO: 1293 - RNA, 21 nt, Artificial Sequence
  Synthetic oligonucleotide
uguggcuaaacacuugaagac

SEQ ID NO: 1294 - RNA, 21 nt, Artificial Sequence
  Synthetic oligonucleotide
guggcuaaacacuugaagacc

SEQ ID NO: 1295 - RNA, 21 nt, Artificial Sequence
  Synthetic oligonucleotide
uggcuaaacacuugaagacca

SEQ ID NO: 1296 - RNA, 21 nt, Artificial Sequence
  Synthetic oligonucleotide
ggcuaaacacuugaagaccau

SEQ ID NO: 1297 - RNA, 21 nt, Artificial Sequence
  Synthetic oligonucleotide
acacuugaagaccauaaacca

SEQ ID NO: 1298 - RNA, 21 nt, Artificial Sequence
  Synthetic oligonucleotide
cacuugaagaccauaaaccaa

SEQ ID NO: 1299 - RNA, 21 nt, Artificial Sequence
  Synthetic oligonucleotide
gaagaccauaaaccaagaaag

SEQ ID NO: 1300 - RNA, 21 nt, Artificial Sequence
  Synthetic oligonucleotide
ugcaucgaaccauuagcagaa

SEQ ID NO: 1301 - RNA, 21 nt, Artificial Sequence
  Synthetic oligonucleotide
gcaucgaaccauuagcagaaa

SEQ ID NO: 1302 - RNA, 21 nt, Artificial Sequence
  Synthetic oligonucleotide
gaaccauuagcagaaaguauc

SEQ ID NO: 1303 - RNA, 21 nt, Artificial Sequence
  Synthetic oligonucleotide
acgggacuggcuaguuaaaca

SEQ ID NO: 1304 - RNA, 21 nt, Artificial Sequence
  Synthetic oligonucleotide
cgggacuggcuaguuaaacaa

SEQ ID NO: 1305 - RNA, 21 nt, Artificial Sequence
  Synthetic oligonucleotide
ggcuaguuaaacaaagaggcu

SEQ ID NO: 1306 - RNA, 21 nt, Artificial Sequence
  Synthetic oligonucleotide
uuaaacaaagaggcugggaug

SEQ ID NO: 1307 - RNA, 21 nt, Artificial Sequence
  Synthetic oligonucleotide
uaaacaaagaggcugggaugg

SEQ ID NO: 1308 - RNA, 21 nt, Artificial Sequence
  Synthetic oligonucleotide
aaacaaagaggcugggauggg

SEQ ID NO: 1309 - RNA, 21 nt, Artificial Sequence
  Synthetic oligonucleotide
aacaaagaggcugggaugggu

SEQ ID NO: 1310 - RNA, 21 nt, Artificial Sequence
  Synthetic oligonucleotide
acaaagaggcugggauggguu

SEQ ID NO: 1311 - RNA, 21 nt, Artificial Sequence
  Synthetic oligonucleotide
caaagaggcugggauggguuu

SEQ ID NO: 1312 - RNA, 21 nt, Artificial Sequence
  Synthetic oligonucleotide
aaagaggcugggauggguuug

SEQ ID NO: 1313 - RNA, 21 nt, Artificial Sequence
  Synthetic oligonucleotide
aagaggcugggauggguuugu

SEQ ID NO: 1314 - RNA, 21 nt, Artificial Sequence
  Synthetic oligonucleotide
agaggcugggauggguuugug

SEQ ID NO: 1315 - RNA, 21 nt, Artificial Sequence
  Synthetic oligonucleotide
gaggcugggauggguuugugg

SEQ ID NO: 1316 - RNA, 21 nt, Artificial Sequence
  Synthetic oligonucleotide
aggcugggauggguuugugga

SEQ ID NO: 1317 - RNA, 21 nt, Artificial Sequence
  Synthetic oligonucleotide
ggcugggauggguuuguggag

SEQ ID NO: 1318 - RNA, 21 nt, Artificial Sequence
  Synthetic oligonucleotide
gcugggauggguuuguggagu

SEQ ID NO: 1319 - RNA, 21 nt, Artificial Sequence
  Synthetic oligonucleotide
cugggauggguuuguggaguu

SEQ ID NO: 1320 - RNA, 21 nt, Artificial Sequence
  Synthetic oligonucleotide
ugggauggguuuguggaguuc

SEQ ID NO: 1321 - RNA, 21 nt, Artificial Sequence
  Synthetic oligonucleotide
gggauggguuuguggaguucu

SEQ ID NO: 1322 - RNA, 21 nt, Artificial Sequence
  Synthetic oligonucleotide
ggauggguuuguggaguucuu

SEQ ID NO: 1323 - RNA, 21 nt, Artificial Sequence
  Synthetic oligonucleotide
gauggguuuguggaguucuuc

SEQ ID NO: 1324 - RNA, 21 nt, Artificial Sequence
  Synthetic oligonucleotide
auggguuuguggaguucuucc

SEQ ID NO: 1325 - RNA, 21 nt, Artificial Sequence
  Synthetic oligonucleotide
uggguuuguggaguucuucca

SEQ ID NO: 1326 - RNA, 21 nt, Artificial Sequence
  Synthetic oligonucleotide
ggaguucuuccauguagagga

SEQ ID NO: 1327 - RNA, 21 nt, Artificial Sequence
  Synthetic oligonucleotide
uuccauguagaggaccuagaa

SEQ ID NO: 1328 - RNA, 21 nt, Artificial Sequence
  Synthetic oligonucleotide
gaggaccuagaagguggcauc

SEQ ID NO: 1329 - RNA, 21 nt, Artificial Sequence
  Synthetic oligonucleotide
cagguguugcuggaguaggag

SEQ ID NO: 1330 - RNA, 21 nt, Artificial Sequence
  Synthetic oligonucleotide
agcugguuuggcauaucuaau

SEQ ID NO: 1331 - RNA, 21 nt, Artificial Sequence
  Synthetic oligonucleotide
uuuggcauaucuaauaagaua

SEQ ID NO: 1332 - RNA, 21 nt, Artificial Sequence
  Synthetic oligonucleotide
uuggcauaucuaauaagauag

SEQ ID NO: 1333 - RNA, 21 nt, Artificial Sequence
  Synthetic oligonucleotide
uggcauaucuaauaagauagc

SEQ ID NO: 1334 - RNA, 21 nt, Artificial Sequence
  Synthetic oligonucleotide
ggcauaucuaauaagauagcc

SEQ ID NO: 1335 - RNA, 21 nt, Artificial Sequence
  Synthetic oligonucleotide
gcauaucuaauaagauagccu

SEQ ID NO: 1336 - RNA, 21 nt, Artificial Sequence
  Synthetic oligonucleotide
cauaucuaauaagauagccuu

SEQ ID NO: 1337 - RNA, 21 nt, Artificial Sequence
  Synthetic oligonucleotide
uagccuuacuguaagugcaau

SEQ ID NO: 1338 - RNA, 21 nt, Artificial Sequence
  Synthetic oligonucleotide
uuggacuccaagcuguaacuu

SEQ ID NO: 1339 - RNA, 21 nt, Artificial Sequence
  Synthetic oligonucleotide
acuuccuagaguugcacccua

SEQ ID NO: 1340 - RNA, 21 nt, Artificial Sequence
  Synthetic oligonucleotide
aagcaaguggcaagaggauua

SEQ ID NO: 1341 - RNA, 21 nt, Artificial Sequence
  Synthetic oligonucleotide
aguggcaagaggauuauggcu

SEQ ID NO: 1342 - RNA, 21 nt, Artificial Sequence
  Synthetic oligonucleotide
guggcaagaggauuauggcua

SEQ ID NO: 1343 - RNA, 21 nt, Artificial Sequence
  Synthetic oligonucleotide
aagaggauuauggcuaacaag

SEQ ID NO: 1344 - RNA, 21 nt, Artificial Sequence
  Synthetic oligonucleotide
uauggcuaacaagaauaaaua

SEQ ID NO: 1345 - RNA, 21 nt, Artificial Sequence
  Synthetic oligonucleotide
auggcuaacaagaauaaauac

SEQ ID NO: 1346 - RNA, 21 nt, Artificial Sequence
  Synthetic oligonucleotide
uggcuaacaagaauaaauaca

SEQ ID NO: 1347 - RNA, 21 nt, Artificial Sequence
  Synthetic oligonucleotide
ggcuaacaagaauaaauacau

SEQ ID NO: 1348 - RNA, 21 nt, Artificial Sequence
  Synthetic oligonucleotide
gcuaacaagaauaaauacaug

SEQ ID NO: 1349 - RNA, 21 nt, Artificial Sequence
  Synthetic oligonucleotide
cuaacaagaauaaauacaugg

SEQ ID NO: 1350 - RNA, 21 nt, Artificial Sequence
  Synthetic oligonucleotide
uaacaagaauaaauacauggg

SEQ ID NO: 1351 - RNA, 21 nt, Artificial Sequence
  Synthetic oligonucleotide
aacaagaauaaauacauggga

SEQ ID NO: 1352 - RNA, 21 nt, Artificial Sequence
  Synthetic oligonucleotide
acaagaauaaauacaugggaa

SEQ ID NO: 1353 - RNA, 21 nt, Artificial Sequence
  Synthetic oligonucleotide
caagaauaaauacaugggaag

SEQ ID NO: 1354 - RNA, 21 nt, Artificial Sequence
  Synthetic oligonucleotide
cccauugauugaagagucacu

SEQ ID NO: 1355 - RNA, 21 nt, Artificial Sequence
  Synthetic oligonucleotide
cacugucugaaagaagcaaag

SEQ ID NO: 1356 - RNA, 21 nt, Artificial Sequence
  Synthetic oligonucleotide
aaacaaacuuuguuugggaag

SEQ ID NO: 1357 - RNA, 21 nt, Artificial Sequence
  Synthetic oligonucleotide
ggaggacuuuuagauuuagug

SEQ ID NO: 1358 - RNA, 21 nt, Artificial Sequence
  Synthetic oligonucleotide
gaagaugguaggguggaaaga

SEQ ID NO: 1359 - RNA, 21 nt, Artificial Sequence
  Synthetic oligonucleotide
uccuuguugagaacaggaaag

SEQ ID NO: 1360 - RNA, 21 nt, Artificial Sequence
  Synthetic oligonucleotide
uagccaggcaagucauagaau

SEQ ID NO: 1361 - RNA, 21 nt, Artificial Sequence
  Synthetic oligonucleotide
ccaggcaagucauagaauuga

SEQ ID NO: 1362 - RNA, 21 nt, Artificial Sequence
  Synthetic oligonucleotide
caggcaagucauagaauugau

SEQ ID NO: 1363 - RNA, 21 nt, Artificial Sequence
  Synthetic oligonucleotide
uacccgccgaauucauuaauu

SEQ ID NO: 1364 - RNA, 21 nt, Artificial Sequence
  Synthetic oligonucleotide
gccgaauucauuaauuuacug

SEQ ID NO: 1365 - RNA, 21 nt, Artificial Sequence
  Synthetic oligonucleotide
uaguguuaagagaagcacuaa

SEQ ID NO: 1366 - RNA, 21 nt, Artificial Sequence
  Synthetic oligonucleotide
gaagcacuaagaaugccagug

SEQ ID NO: 1367 - RNA, 21 nt, Artificial Sequence
  Synthetic oligonucleotide
acaaguaauagaacuaugacu

SEQ ID NO: 1368 - RNA, 21 nt, Artificial Sequence
  Synthetic oligonucleotide
aaguaauagaacuaugacugu

SEQ ID NO: 1369 - RNA, 21 nt, Artificial Sequence
  Synthetic oligonucleotide
gccucaguacuguacaaggga

SEQ ID NO: 1370 - RNA, 21 nt, Artificial Sequence
  Synthetic oligonucleotide
ucccaguauacuucuuagaaa

SEQ ID NO: 1371 - RNA, 21 nt, Artificial Sequence
  Synthetic oligonucleotide
uaccuguuauacuuuggcuug

SEQ ID NO: 1372 - RNA, 21 nt, Artificial Sequence
  Synthetic oligonucleotide
agccuaguuuaucaccaauaa

SEQ ID NO: 1373 - RNA, 21 nt, Artificial Sequence
  Synthetic oligonucleotide
aucaccaauaauacuugacgg

SEQ ID NO: 1374 - RNA, 21 nt, Artificial Sequence
  Synthetic oligonucleotide
ucaccaauaauacuugacgga

SEQ ID NO: 1375 - RNA, 21 nt, Artificial Sequence
  Synthetic oligonucleotide
caccaauaauacuugacggaa

SEQ ID NO: 1376 - RNA, 21 nt, Artificial Sequence
  Synthetic oligonucleotide
aaggcucaguaauuaguuaug

SEQ ID NO: 1377 - RNA, 21 nt, Artificial Sequence
  Synthetic oligonucleotide
cucaguaauuaguuaugaaua

SEQ ID NO: 1378 - RNA, 21 nt, Artificial Sequence
  Synthetic oligonucleotide
auucuuaagacagcuuguaaa

SEQ ID NO: 1379 - RNA, 21 nt, Artificial Sequence
  Synthetic oligonucleotide
uguaaaaauuguauauauuuu

SEQ ID NO: 1380 - RNA, 21 nt, Artificial Sequence
  Synthetic oligonucleotide
uuuacagaaagucuauuucuu

SEQ ID NO: 1381 - RNA, 21 nt, Artificial Sequence
  Synthetic oligonucleotide
uuacagaaagucuauuucuuu

SEQ ID NO: 1382 - RNA, 21 nt, Artificial Sequence
  Synthetic oligonucleotide
uacagaaagucuauuucuuug

SEQ ID NO: 1383 - RNA, 21 nt, Artificial Sequence
  Synthetic oligonucleotide
acagaaagucuauuucuuuga

SEQ ID NO: 1384 - RNA, 21 nt, Artificial Sequence
  Synthetic oligonucleotide
cagaaagucuauuucuuugaa

SEQ ID NO: 1385 - RNA, 21 nt, Artificial Sequence
  Synthetic oligonucleotide
aacgaaggaaguaucgaauuu

SEQ ID NO: 1386 - RNA, 21 nt, Artificial Sequence
  Synthetic oligonucleotide
aucgaauuuacauuaguuuuu

SEQ ID NO: 1387 - RNA, 21 nt, Artificial Sequence
  Synthetic oligonucleotide
gaacuuugcaacuuccguaau

SEQ ID NO: 1388 - RNA, 21 nt, Artificial Sequence
  Synthetic oligonucleotide
agaguguauacagaacgaauu

SEQ ID NO: 1389 - RNA, 21 nt, Artificial Sequence
  Synthetic oligonucleotide
guggaacaaaucugauaacua

SEQ ID NO: 1390 - RNA, 21 nt, Artificial Sequence
  Synthetic oligonucleotide
aaauuuucuuaucugauuuug

SEQ ID NO: 1391 - RNA, 21 nt, Artificial Sequence
  Synthetic oligonucleotide
uagguuuuucuuugaaaaccu

SEQ ID NO: 1392 - RNA, 21 nt, Artificial Sequence
  Synthetic oligonucleotide
cugggauugagagguugauga

SEQ ID NO: 1393 - RNA, 21 nt, Artificial Sequence
  Synthetic oligonucleotide
ugagagguugaugaauggaaa

SEQ ID NO: 1394 - RNA, 21 nt, Artificial Sequence
  Synthetic oligonucleotide
agguugaugaauggaaauucu

SEQ ID NO: 1395 - RNA, 21 nt, Artificial Sequence
  Synthetic oligonucleotide
uauaugcaaguuuucaauaau

SEQ ID NO: 1396 - RNA, 21 nt, Artificial Sequence
  Synthetic oligonucleotide
aagguuacugaugacuuacaa

SEQ ID NO: 1397 - RNA, 21 nt, Artificial Sequence
  Synthetic oligonucleotide
auugggcaauacucauuugag

SEQ ID NO: 1398 - RNA, 21 nt, Artificial Sequence
  Synthetic oligonucleotide
uuccauuugaccuaauuuaac

SEQ ID NO: 1399 - RNA, 21 nt, Artificial Sequence
  Synthetic oligonucleotide
uuaaagcuuuuacuaaaagau

SEQ ID NO: 1400 - RNA, 21 nt, Artificial Sequence
  Synthetic oligonucleotide
cagguggauggagagacauuu

SEQ ID NO: 1401 - RNA, 21 nt, Artificial Sequence
  Synthetic oligonucleotide
ugcuuaauaaauuauaaaaug

SEQ ID NO: 1402 - RNA, 21 nt, Artificial Sequence
  Synthetic oligonucleotide
uaaccauggugcuauuauuag

SEQ ID NO: 1403 - RNA, 21 nt, Artificial Sequence
  Synthetic oligonucleotide
uaagccuaguaugucaauaaa

SEQ ID NO: 1404 - RNA, 21 nt, Artificial Sequence
  Synthetic oligonucleotide
uacuguuuuguuucuauuaau

SEQ ID NO: 1405 - RNA, 21 nt, Artificial Sequence
  Synthetic oligonucleotide
uucuauuaaugauucccaaac

SEQ ID NO: 1406 - RNA, 21 nt, Artificial Sequence
  Synthetic oligonucleotide
cuuguugcaaguuuuugcauu

SEQ ID NO: 1407 - RNA, 21 nt, Artificial Sequence
  Synthetic oligonucleotide
uuggauuucagucuugauguu

SEQ ID NO: 1408 - RNA, 21 nt, Artificial Sequence
  Synthetic oligonucleotide
cuuccuugaaauugcugauug

SEQ ID NO: 1409 - RNA, 21 nt, Artificial Sequence
  Synthetic oligonucleotide
gcucccucuacagauauuuau

SEQ ID NO: 1410 - RNA, 21 nt, Artificial Sequence
  Synthetic oligonucleotide
ccaccaagaguccacagaccu

SEQ ID NO: 1411 - RNA, 21 nt, Artificial Sequence
  Synthetic oligonucleotide
caccaagaguccacagaccuu

SEQ ID NO: 1412 - RNA, 21 nt, Artificial Sequence
  Synthetic oligonucleotide
gaguccacagaccuuucaucu

SEQ ID NO: 1413 - RNA, 21 nt, Artificial Sequence
  Synthetic oligonucleotide
aguccacagaccuuucaucuu

SEQ ID NO: 1414 - RNA, 21 nt, Artificial Sequence
  Synthetic oligonucleotide
guccacagaccuuucaucuuu

SEQ ID NO: 1415 - RNA, 21 nt, Artificial Sequence
  Synthetic oligonucleotide
uccacagaccuuucaucuuuc

SEQ ID NO: 1416 - RNA, 21 nt, Artificial Sequence
  Synthetic oligonucleotide
acagaccuuucaucuuucacg

SEQ ID NO: 1417 - RNA, 21 nt, Artificial Sequence
  Synthetic oligonucleotide
gaccuuucaucuuucacgaac

SEQ ID NO: 1418 - RNA, 21 nt, Artificial Sequence
  Synthetic oligonucleotide
cugugacacuaacagucauug

SEQ ID NO: 1419 - RNA, 21 nt, Artificial Sequence
  Synthetic oligonucleotide
cacuaacagucauugagaggu

SEQ ID NO: 1420 - RNA, 21 nt, Artificial Sequence
  Synthetic oligonucleotide
uaggaguaugcucacuuaaau

SEQ ID NO: 1421 - RNA, 21 nt, Artificial Sequence
  Synthetic oligonucleotide
gcucacuuaaauuuacagaaa

SEQ ID NO: 1422 - RNA, 21 nt, Artificial Sequence
  Synthetic oligonucleotide
cacuuaaauuuacagaaagag

SEQ ID NO: 1423 - RNA, 21 nt, Artificial Sequence
  Synthetic oligonucleotide
aaacugaagaaagugucuaua

SEQ ID NO: 1424 - RNA, 21 nt, Artificial Sequence
  Synthetic oligonucleotide
uuggaacuagggucauuugaa

SEQ ID NO: 1425 - RNA, 21 nt, Artificial Sequence
  Synthetic oligonucleotide
aacuagggucauuugaaagcu

SEQ ID NO: 1426 - RNA, 21 nt, Artificial Sequence
  Synthetic oligonucleotide
acuagggucauuugaaagcuu

SEQ ID NO: 1427 - RNA, 21 nt, Artificial Sequence
  Synthetic oligonucleotide
cuagggucauuugaaagcuuc

SEQ ID NO: 1428 - RNA, 21 nt, Artificial Sequence
  Synthetic oligonucleotide
uagggucauuugaaagcuuca

SEQ ID NO: 1429 - RNA, 21 nt, Artificial Sequence
  Synthetic oligonucleotide
agggucauuugaaagcuucag

SEQ ID NO: 1430 - RNA, 21 nt, Artificial Sequence
  Synthetic oligonucleotide
ucagucucggaacaugaccuu

SEQ ID NO: 1431 - RNA, 21 nt, Artificial Sequence
  Synthetic oligonucleotide
cggaacaugaccuuuagucug

SEQ ID NO: 1432 - RNA, 21 nt, Artificial Sequence
  Synthetic oligonucleotide
gaacaugaccuuuagucugug

SEQ ID NO: 1433 - RNA, 21 nt, Artificial Sequence
  Synthetic oligonucleotide
uccauuuaaaaauagguauga

SEQ ID NO: 1434 - RNA, 21 nt, Artificial Sequence
  Synthetic oligonucleotide
uagguaugaauaagaugacua

SEQ ID NO: 1435 - RNA, 21 nt, Artificial Sequence
  Synthetic oligonucleotide
cugcccaucucagagccauaa

SEQ ID NO: 1436 - RNA, 21 nt, Artificial Sequence
  Synthetic oligonucleotide
uuaccuauguauuuaucguuc

SEQ ID NO: 1437 - RNA, 21 nt, Artificial Sequence
  Synthetic oligonucleotide
aagccgcuuauuuauaucaug

SEQ ID NO: 1438 - RNA, 21 nt, Artificial Sequence
  Synthetic oligonucleotide
auguaguuuuuaauuaaucuu

SEQ ID NO: 1439 - RNA, 21 nt, Artificial Sequence
  Synthetic oligonucleotide
agccugucugccaaauccagu

SEQ ID NO: 1440 - RNA, 21 nt, Artificial Sequence
  Synthetic oligonucleotide
ucugccaaauccaguggaaac

SEQ ID NO: 1441 - RNA, 21 nt, Artificial Sequence
  Synthetic oligonucleotide
ccaguggaaacaagugcauag

SEQ ID NO: 1442 - RNA, 21 nt, Artificial Sequence
  Synthetic oligonucleotide
guggaaacaagugcauagaug

SEQ ID NO: 1443 - RNA, 21 nt, Artificial Sequence
  Synthetic oligonucleotide
ccacuucccaauucauuaggu

SEQ ID NO: 1444 - RNA, 21 nt, Artificial Sequence
  Synthetic oligonucleotide
uagguaugacuguggaaauac

SEQ ID NO: 1445 - RNA, 21 nt, Artificial Sequence
  Synthetic oligonucleotide
augacuguggaaauacagaca

SEQ ID NO: 1446 - RNA, 21 nt, Artificial Sequence
  Synthetic oligonucleotide
ugacuguggaaauacagacaa

SEQ ID NO: 1447 - RNA, 21 nt, Artificial Sequence
  Synthetic oligonucleotide
acuguggaaauacagacaagg

SEQ ID NO: 1448 - RNA, 21 nt, Artificial Sequence
  Synthetic oligonucleotide
cuguggaaauacagacaagga

SEQ ID NO: 1449 - RNA, 21 nt, Artificial Sequence
  Synthetic oligonucleotide
uguggaaauacagacaaggau

SEQ ID NO: 1450 - RNA, 21 nt, Artificial Sequence
  Synthetic oligonucleotide
guggaaauacagacaaggauc

SEQ ID NO: 1451 - RNA, 21 nt, Artificial Sequence
  Synthetic oligonucleotide
uggaaauacagacaaggaucu

SEQ ID NO: 1452 - RNA, 21 nt, Artificial Sequence
  Synthetic oligonucleotide
gaggaggaggcagguggucua

SEQ ID NO: 1453 - RNA, 21 nt, Artificial Sequence
  Synthetic oligonucleotide
uggcuacguaguucgggcaaa

SEQ ID NO: 1454 - RNA, 21 nt, Artificial Sequence
  Synthetic oligonucleotide
ggaggauuugcuuagaaggau

SEQ ID NO: 1455 - RNA, 21 nt, Artificial Sequence
  Synthetic oligonucleotide
gaggauuugcuuagaaggaug

SEQ ID NO: 1456 - RNA, 21 nt, Artificial Sequence
  Synthetic oligonucleotide
guccucuaguguuucauguac

SEQ ID NO: 1457 - RNA, 21 nt, Artificial Sequence
  Synthetic oligonucleotide
gaacaccuugguucugguuaa

SEQ ID NO: 1458 - RNA, 21 nt, Artificial Sequence
  Synthetic oligonucleotide
auagcugugccaggaaggguu

SEQ ID NO: 1459 - RNA, 21 nt, Artificial Sequence
  Synthetic oligonucleotide
ccaggaaggguuaggaccaac

SEQ ID NO: 1460 - RNA, 21 nt, Artificial Sequence
  Synthetic oligonucleotide
aggguuaggaccaacuacaaa

SEQ ID NO: 1461 - RNA, 21 nt, Artificial Sequence
  Synthetic oligonucleotide
agggaacggccuuccucacuc

SEQ ID NO: 1462 - RNA, 21 nt, Artificial Sequence
  Synthetic oligonucleotide
cugcggagaaacgcggucauc

SEQ ID NO: 1463 - RNA, 21 nt, Artificial Sequence
  Synthetic oligonucleotide
ccggaggaggaacuggacggc

SEQ ID NO: 1464 - RNA, 21 nt, Artificial Sequence
  Synthetic oligonucleotide
cgaggaggaagaggacgaccu

SEQ ID NO: 1465 - RNA, 21 nt, Artificial Sequence
  Synthetic oligonucleotide
gaggaggaagaggacgaccua

SEQ ID NO: 1466 - RNA, 21 nt, Artificial Sequence
  Synthetic oligonucleotide
aggaggaagaggacgaccuau

SEQ ID NO: 1467 - RNA, 21 nt, Artificial Sequence
  Synthetic oligonucleotide
gaggaagaggacgaccuauac

SEQ ID NO: 1468 - RNA, 21 nt, Artificial Sequence
  Synthetic oligonucleotide
caggauugugacucuuauuuc

SEQ ID NO: 1469 - RNA, 21 nt, Artificial Sequence
  Synthetic oligonucleotide
uguggccaaacacuuaaagag

SEQ ID NO: 1470 - RNA, 21 nt, Artificial Sequence
  Synthetic oligonucleotide
guggccaaacacuuaaagagc

SEQ ID NO: 1471 - RNA, 21 nt, Artificial Sequence
  Synthetic oligonucleotide
uggccaaacacuuaaagagcg

SEQ ID NO: 1472 - RNA, 21 nt, Artificial Sequence
  Synthetic oligonucleotide
aaagagcguaaaccaagaaag

SEQ ID NO: 1473 - RNA, 21 nt, Artificial Sequence
  Synthetic oligonucleotide
cgaaccauuagcagaaacuau

SEQ ID NO: 1474 - RNA, 21 nt, Artificial Sequence
  Synthetic oligonucleotide
uuagcagaaacuaucacagau

SEQ ID NO: 1475 - RNA, 21 nt, Artificial Sequence
  Synthetic oligonucleotide
acgggacuggcuugucaaaca

SEQ ID NO: 1476 - RNA, 21 nt, Artificial Sequence
  Synthetic oligonucleotide
cgggacuggcuugucaaacaa

SEQ ID NO: 1477 - RNA, 21 nt, Artificial Sequence
  Synthetic oligonucleotide
uuguggaguucuuccacguac

SEQ ID NO: 1478 - RNA, 21 nt, Artificial Sequence
  Synthetic oligonucleotide
ggaguucuuccacguacagga

SEQ ID NO: 1479 - RNA, 21 nt, Artificial Sequence
  Synthetic oligonucleotide
uuccacguacaggaccuagaa

SEQ ID NO: 1480 - RNA, 21 nt, Artificial Sequence
  Synthetic oligonucleotide
cuggucuggcauaucuaauaa

SEQ ID NO: 1481 - RNA, 21 nt, Artificial Sequence
  Synthetic oligonucleotide
agccaccaaacuacaugcauc

SEQ ID NO: 1482 - RNA, 21 nt, Artificial Sequence
  Synthetic oligonucleotide
cauguguauuuaugaaggugg

SEQ ID NO: 1483 - RNA, 21 nt, Artificial Sequence
  Synthetic oligonucleotide
uguguauuuaugaagguggac

SEQ ID NO: 1484 - RNA, 21 nt, Artificial Sequence
  Synthetic oligonucleotide
guauuuaugaagguggacuug

SEQ ID NO: 1485 - RNA, 21 nt, Artificial Sequence
  Synthetic oligonucleotide
guccaguucuacuguagcaac

SEQ ID NO: 1486 - RNA, 21 nt, Artificial Sequence
  Synthetic oligonucleotide
cccuggaagagucacugucug

SEQ ID NO: 1487 - RNA, 21 nt, Artificial Sequence
  Synthetic oligonucleotide
ccuggaagagucacugucuga

SEQ ID NO: 1488 - RNA, 21 nt, Artificial Sequence
  Synthetic oligonucleotide
cuggaagagucacugucugaa

SEQ ID NO: 1489 - RNA, 21 nt, Artificial Sequence
  Synthetic oligonucleotide
cacugucugaaugaagcaaag

SEQ ID NO: 1490 - RNA, 21 nt, Artificial Sequence
  Synthetic oligonucleotide
uucccucucagcaaacacuga

SEQ ID NO: 1491 - RNA, 21 nt, Artificial Sequence
  Synthetic oligonucleotide
ucccucucagcaaacacugag

SEQ ID NO: 1492 - RNA, 21 nt, Artificial Sequence
  Synthetic oligonucleotide
ucagcaaacacugagaggcca

SEQ ID NO: 1493 - RNA, 21 nt, Artificial Sequence
  Synthetic oligonucleotide
aacacugagaggccauggaga

SEQ ID NO: 1494 - RNA, 21 nt, Artificial Sequence
  Synthetic oligonucleotide
gaggccauggagaaggacuuc

SEQ ID NO: 1495 - RNA, 21 nt, Artificial Sequence
  Synthetic oligonucleotide
aggccauggagaaggacuucu

SEQ ID NO: 1496 - RNA, 21 nt, Artificial Sequence
  Synthetic oligonucleotide
uggagaaggacuucuagaaug

SEQ ID NO: 1497 - RNA, 21 nt, Artificial Sequence
  Synthetic oligonucleotide
gaaggacuucuagaaugaaug

SEQ ID NO: 1498 - RNA, 21 nt, Artificial Sequence
  Synthetic oligonucleotide
guggauggaaagguuugauuu

SEQ ID NO: 1499 - RNA, 21 nt, Artificial Sequence
  Synthetic oligonucleotide
ccagucaucaggcuagucaca

SEQ ID NO: 1500 - RNA, 21 nt, Artificial Sequence
  Synthetic oligonucleotide
cagucaucaggcuagucacaa

SEQ ID NO: 1501 - RNA, 21 nt, Artificial Sequence
  Synthetic oligonucleotide
aggcuagucacaaagcucaau

SEQ ID NO: 1502 - RNA, 21 nt, Artificial Sequence
  Synthetic oligonucleotide
aagcccuaauuaacaacguug

SEQ ID NO: 1503 - RNA, 21 nt, Artificial Sequence
  Synthetic oligonucleotide
aaccuacaagucaccaaacga

SEQ ID NO: 1504 - RNA, 21 nt, Artificial Sequence
  Synthetic oligonucleotide
accuacaagucaccaaacgau

SEQ ID NO: 1505 - RNA, 21 nt, Artificial Sequence
  Synthetic oligonucleotide
agucaccaaacgaugacuaga

SEQ ID NO: 1506 - RNA, 21 nt, Artificial Sequence
  Synthetic oligonucleotide
gucaccaaacgaugacuagaa

SEQ ID NO: 1507 - RNA, 21 nt, Artificial Sequence
  Synthetic oligonucleotide
ucaccaaacgaugacuagaag

SEQ ID NO: 1508 - RNA, 21 nt, Artificial Sequence
  Synthetic oligonucleotide
caccaaacgaugacuagaagc

SEQ ID NO: 1509 - RNA, 21 nt, Artificial Sequence
  Synthetic oligonucleotide
caggaaugugaagggaggccu

SEQ ID NO: 1510 - RNA, 21 nt, Artificial Sequence
  Synthetic oligonucleotide
ugugcuugacaaagucccaag

SEQ ID NO: 1511 - RNA, 21 nt, Artificial Sequence
  Synthetic oligonucleotide
gugcuugacaaagucccaagu

SEQ ID NO: 1512 - RNA, 21 nt, Artificial Sequence
  Synthetic oligonucleotide
uugacaaagucccaagugcuc

SEQ ID NO: 1513 - RNA, 21 nt, Artificial Sequence
  Synthetic oligonucleotide
agcccugucuacuuuggcuug

SEQ ID NO: 1514 - RNA, 21 nt, Artificial Sequence
  Synthetic oligonucleotide
uucuuaaguuuauuagccuag

SEQ ID NO: 1515 - RNA, 21 nt, Artificial Sequence
  Synthetic oligonucleotide
aaaguacuugacuuaagguuc

SEQ ID NO: 1516 - RNA, 21 nt, Artificial Sequence
  Synthetic oligonucleotide
gaacauaagagggaagucuug

SEQ ID NO: 1517 - RNA, 21 nt, Artificial Sequence
  Synthetic oligonucleotide
cagcuucucuaguuagaaaug

SEQ ID NO: 1518 - RNA, 21 nt, Artificial Sequence
  Synthetic oligonucleotide
ugucauccguucuaguguaua

SEQ ID NO: 1519 - RNA, 21 nt, Artificial Sequence
  Synthetic oligonucleotide
uguguguggacugguuauaga

SEQ ID NO: 1520 - RNA, 21 nt, Artificial Sequence
  Synthetic oligonucleotide
uaacuaugcaggguuaauuau

SEQ ID NO: 1521 - RNA, 21 nt, Artificial Sequence
  Synthetic oligonucleotide
aucacagguagauagauguaa

SEQ ID NO: 1522 - RNA, 21 nt, Artificial Sequence
  Synthetic oligonucleotide
agguagauagauguaagacau

SEQ ID NO: 1523 - RNA, 21 nt, Artificial Sequence
  Synthetic oligonucleotide
guaaaugguaaagcaggcuag

SEQ ID NO: 1524 - RNA, 21 nt, Artificial Sequence
  Synthetic oligonucleotide
auggugcuauucacuggguuu

SEQ ID NO: 1525 - RNA, 21 nt, Artificial Sequence
  Synthetic oligonucleotide
uuucuugucuacuaaggauug

SEQ ID NO: 1526 - RNA, 21 nt, Artificial Sequence
  Synthetic oligonucleotide
uggucucuagguguagccuuu

SEQ ID NO: 1527 - RNA, 21 nt, Artificial Sequence
  Synthetic oligonucleotide
cccuauagagucgucuacacu

SEQ ID NO: 1528 - RNA, 21 nt, Artificial Sequence
  Synthetic oligonucleotide
gucgucuacacuuccucccug

SEQ ID NO: 1529 - RNA, 21 nt, Artificial Sequence
  Synthetic oligonucleotide
uaguuaucugcauuagaacuc

SEQ ID NO: 1530 - RNA, 21 nt, Artificial Sequence
  Synthetic oligonucleotide
auccuaaucagagucagcaca

SEQ ID NO: 1531 - RNA, 21 nt, Artificial Sequence
  Synthetic oligonucleotide
acagcuuuccugucagaggau

SEQ ID NO: 1532 - RNA, 21 nt, Artificial Sequence
  Synthetic oligonucleotide
uuccugucagaggauaggaac

SEQ ID NO: 1533 - RNA, 21 nt, Artificial Sequence
  Synthetic oligonucleotide
cugucagaggauaggaacacu

SEQ ID NO: 1534 - RNA, 21 nt, Artificial Sequence
  Synthetic oligonucleotide
ugucagaggauaggaacacuu

SEQ ID NO: 1535 - RNA, 21 nt, Artificial Sequence
  Synthetic oligonucleotide
gaccgacagugaccagggauu

SEQ ID NO: 1536 - RNA, 21 nt, Artificial Sequence
  Synthetic oligonucleotide
caugcuuuccauuguuacuuu

SEQ ID NO: 1537 - RNA, 21 nt, Artificial Sequence
  Synthetic oligonucleotide
aagguuggaaauuauacguuu

SEQ ID NO: 1538 - RNA, 21 nt, Artificial Sequence
  Synthetic oligonucleotide
uuauuaguuugcuccaaguau

SEQ ID NO: 1539 - RNA, 21 nt, Artificial Sequence
  Synthetic oligonucleotide
uucacuuaaguuuagagaaac

SEQ ID NO: 1540 - RNA, 21 nt, Artificial Sequence
  Synthetic oligonucleotide
ccacugguaacugaagguauu

SEQ ID NO: 1541 - RNA, 21 nt, Artificial Sequence
  Synthetic oligonucleotide
cagccucagaaugugaccuuu

SEQ ID NO: 1542 - RNA, 21 nt, Artificial Sequence
  Synthetic oligonucleotide
aauaggcaggaaucaaaugac

SEQ ID NO: 1543 - RNA, 21 nt, Artificial Sequence
  Synthetic oligonucleotide
auaggcaggaaucaaaugacu

SEQ ID NO: 1544 - RNA, 21 nt, Artificial Sequence
  Synthetic oligonucleotide
uaggcaggaaucaaaugacua

SEQ ID NO: 1545 - RNA, 21 nt, Artificial Sequence
  Synthetic oligonucleotide
aggcaggaaucaaaugacuaa

SEQ ID NO: 1546 - RNA, 21 nt, Artificial Sequence
  Synthetic oligonucleotide
ggcaggaaucaaaugacuaag

SEQ ID NO: 1547 - RNA, 21 nt, Artificial Sequence
  Synthetic oligonucleotide
gcaggaaucaaaugacuaaga

SEQ ID NO: 1548 - RNA, 21 nt, Artificial Sequence
  Synthetic oligonucleotide
caggaaucaaaugacuaagaa

SEQ ID NO: 1549 - RNA, 21 nt, Artificial Sequence
  Synthetic oligonucleotide
aggaaucaaaugacuaagaau

SEQ ID NO: 1550 - RNA, 21 nt, Artificial Sequence
  Synthetic oligonucleotide
augacuaagaauguaauaggg

SEQ ID NO: 1551 - RNA, 21 nt, Artificial Sequence
  Synthetic oligonucleotide
cugccagcuugggagugauuu

SEQ ID NO: 1552 - RNA, 21 nt, Artificial Sequence
  Synthetic oligonucleotide
auccuugaucauaguuugcuu

SEQ ID NO: 1553 - RNA, 21 nt, Artificial Sequence
  Synthetic oligonucleotide
agagcacuuuauguaguugaa

SEQ ID NO: 1554 - RNA, 21 nt, Artificial Sequence
  Synthetic oligonucleotide
gagcacuuuauguaguugaau

SEQ ID NO: 1555 - RNA, 21 nt, Artificial Sequence
  Synthetic oligonucleotide
uuuguuuacuaggagccugac

SEQ ID NO: 1556 - RNA, 21 nt, Artificial Sequence
  Synthetic oligonucleotide
agccugacuucccagcucaca

SEQ ID NO: 1557 - RNA, 21 nt, Artificial Sequence
  Synthetic oligonucleotide
gccugacuucccagcucacaa

SEQ ID NO: 1558 - RNA, 21 nt, Artificial Sequence
  Synthetic oligonucleotide
ccugacuucccagcucacaaa

SEQ ID NO: 1559 - RNA, 21 nt, Artificial Sequence
  Synthetic oligonucleotide
ucccagcucacaaagggugaa

SEQ ID NO: 1560 - RNA, 21 nt, Artificial Sequence
  Synthetic oligonucleotide
agcucacaaagggugaaauga

SEQ ID NO: 1561 - RNA, 21 nt, Artificial Sequence
  Synthetic oligonucleotide
gcugaaguacagacaggaucu

SEQ ID NO: 1562 - RNA, 21 nt, Artificial Sequence
  Synthetic oligonucleotide
gaaguacagacaggaucuuag

SEQ ID NO: 1563 - RNA, 21 nt, Artificial Sequence
  Synthetic oligonucleotide
gggccaugaagacuuggagag

SEQ ID NO: 1564 - RNA, 21 nt, Artificial Sequence
  Synthetic oligonucleotide
cuuuggagggaagaagcaugu

SEQ ID NO: 1565 - RNA, 21 nt, Artificial Sequence
  Synthetic oligonucleotide
ugagugcugacuagaugaaua

SEQ ID NO: 1566 - RNA, 21 nt, Artificial Sequence
  Synthetic oligonucleotide
gcugacuagaugaauaguuga

SEQ ID NO: 1567 - RNA, 21 nt, Artificial Sequence
  Synthetic oligonucleotide
ugaggcacauccuucagagaa

SEQ ID NO: 1568 - RNA, 21 nt, Artificial Sequence
  Synthetic oligonucleotide
gaggcacauccuucagagaag

SEQ ID NO: 1569 - RNA, 21 nt, Artificial Sequence
  Synthetic oligonucleotide
gggcugcuuggaaagauggcu

SEQ ID NO: 1570 - RNA, 21 nt, Artificial Sequence
  Synthetic oligonucleotide
aaucuguuugucuuacacguc

SEQ ID NO: 1571 - RNA, 21 nt, Artificial Sequence
  Synthetic oligonucleotide
caagcaucuuccauguacauu

SEQ ID NO: 1572 - RNA, 21 nt, Artificial Sequence
  Synthetic oligonucleotide
gagcaccuaacacuuuaacag

SEQ ID NO: 1573 - RNA, 21 nt, Artificial Sequence
  Synthetic oligonucleotide
acagcuguucccgaaaggguu

SEQ ID NO: 1574 - RNA, 21 nt, Artificial Sequence
  Synthetic oligonucleotide
cccgaaaggguuaggaccaac

SEQ ID NO: 1575 - RNA, 21 nt, Artificial Sequence
  Synthetic oligonucleotide
gaccaacugcaaguuaaugug

SEQ ID NO: 1576 - RNA, 27 nt, Artificial Sequence
  Synthetic oligonucleotide
ucgccacuucucacuuccgcuuccuca

SEQ ID NO: 1577 - RNA, 27 nt, Artificial Sequence
  Synthetic oligonucleotide
ccacuucucacuuccgcuuccuuccca

SEQ ID NO: 1578 - RNA, 27 nt, Artificial Sequence
  Synthetic oligonucleotide
gcggcggcgacuggcaauguuuggcac

SEQ ID NO: 1579 - RNA, 27 nt, Artificial Sequence
  Synthetic oligonucleotide
aacgcgguaaucggacucaaccucuca

SEQ ID NO: 1580 - RNA, 27 nt, Artificial Sequence
  Synthetic oligonucleotide
ggagggcgacuuuuggcuacggagaca

SEQ ID NO: 1581 - RNA, 27 nt, Artificial Sequence
  Synthetic oligonucleotide
ccgcgaggcugcuuuucuucgcgccac

SEQ ID NO: 1582 - RNA, 27 nt, Artificial Sequence
  Synthetic oligonucleotide
ucugguaauaacaccaguacggacgaa

SEQ ID NO: 1583 - RNA, 27 nt, Artificial Sequence
  Synthetic oligonucleotide
gaggaggaggacgaguuguaccggcca

SEQ ID NO: 1584 - RNA, 27 nt, Artificial Sequence
  Synthetic oligonucleotide
accggcagucgcuggagauuaucucca

SEQ ID NO: 1585 - RNA, 27 nt, Artificial Sequence
  Synthetic oligonucleotide
gccaaggacacaaagccaaugggcaaa

SEQ ID NO: 1586 - RNA, 27 nt, Artificial Sequence
  Synthetic oligonucleotide
caggaaggcgcuggagaccuuacgaaa

SEQ ID NO: 1587 - RNA, 27 nt, Artificial Sequence
  Synthetic oligonucleotide
auggcgugcagcgcaaccacgagacaa

SEQ ID NO: 1588 - RNA, 27 nt, Artificial Sequence
  Synthetic oligonucleotide
uggcgugcagcgcaaccacgagacgaa

SEQ ID NO: 1589 - RNA, 27 nt, Artificial Sequence
  Synthetic oligonucleotide
ggcgugcagcgcaaccacgagacggaa

SEQ ID NO: 1590 - RNA, 27 nt, Artificial Sequence
  Synthetic oligonucleotide
gcgugcagcgcaaccacgagacggcac

SEQ ID NO: 1591 - RNA, 27 nt, Artificial Sequence
  Synthetic oligonucleotide
cgugcagcgcaaccacgagacggcccc

SEQ ID NO: 1592 - RNA, 27 nt, Artificial Sequence
  Synthetic oligonucleotide
gugcagcgcaaccacgagacggccuca

SEQ ID NO: 1593 - RNA, 27 nt, Artificial Sequence
  Synthetic oligonucleotide
ugcagcgcaaccacgagacggccuuaa

SEQ ID NO: 1594 - RNA, 27 nt, Artificial Sequence
  Synthetic oligonucleotide
gcagcgcaaccacgagacggccuucac

SEQ ID NO: 1595 - RNA, 27 nt, Artificial Sequence
  Synthetic oligonucleotide
cagcgcaaccacgagacggccuucccc

SEQ ID NO: 1596 - RNA, 27 nt, Artificial Sequence
  Synthetic oligonucleotide
agcgcaaccacgagacggccuuccaca

SEQ ID NO: 1597 - RNA, 27 nt, Artificial Sequence
  Synthetic oligonucleotide
gcgcaaccacgagacggccuuccaaaa

SEQ ID NO: 1598 - RNA, 27 nt, Artificial Sequence
  Synthetic oligonucleotide
cgcaaccacgagacggccuuccaagaa

SEQ ID NO: 1599 - RNA, 27 nt, Artificial Sequence
  Synthetic oligonucleotide
gcaaccacgagacggccuuccaaggac

SEQ ID NO: 1600 - RNA, 27 nt, Artificial Sequence
  Synthetic oligonucleotide
caaccacgagacggccuuccaaggccc

SEQ ID NO: 1601 - RNA, 27 nt, Artificial Sequence
  Synthetic oligonucleotide
uuccaaggcaugcuucggaaacuggca

SEQ ID NO: 1602 - RNA, 27 nt, Artificial Sequence
  Synthetic oligonucleotide
uccaaggcaugcuucggaaacuggaac

SEQ ID NO: 1603 - RNA, 27 nt, Artificial Sequence
  Synthetic oligonucleotide
aacgaagacgaugugaaaucguuguac

SEQ ID NO: 1604 - RNA, 27 nt, Artificial Sequence
  Synthetic oligonucleotide
gacgaugugaaaucguugucucgagca

SEQ ID NO: 1605 - RNA, 27 nt, Artificial Sequence
  Synthetic oligonucleotide
gggcaggauugugacucucauuucucc

SEQ ID NO: 1606 - RNA, 27 nt, Artificial Sequence
  Synthetic oligonucleotide
uugugacucucauuucuuuuggugcac

SEQ ID NO: 1607 - RNA, 27 nt, Artificial Sequence
  Synthetic oligonucleotide
gccuuuguggcuaaacacuugaagaaa

SEQ ID NO: 1608 - RNA, 27 nt, Artificial Sequence
  Synthetic oligonucleotide
uguggcuaaacacuugaagaccauacc

SEQ ID NO: 1609 - RNA, 27 nt, Artificial Sequence
  Synthetic oligonucleotide
guggcuaaacacuugaagaccauaaca

SEQ ID NO: 1610 - RNA, 27 nt, Artificial Sequence
  Synthetic oligonucleotide
uggcuaaacacuugaagaccauaaaaa

SEQ ID NO: 1611 - RNA, 27 nt, Artificial Sequence
  Synthetic oligonucleotide
ggcuaaacacuugaagaccauaaacac

SEQ ID NO: 1612 - RNA, 27 nt, Artificial Sequence
  Synthetic oligonucleotide
acacuugaagaccauaaaccaagaaca

SEQ ID NO: 1613 - RNA, 27 nt, Artificial Sequence
  Synthetic oligonucleotide
cacuugaagaccauaaaccaagaaaaa

SEQ ID NO: 1614 - RNA, 27 nt, Artificial Sequence
  Synthetic oligonucleotide
gaagaccauaaaccaagaaagcugccc

SEQ ID NO: 1615 - RNA, 27 nt, Artificial Sequence
  Synthetic oligonucleotide
ugcaucgaaccauuagcagaaaguaca

SEQ ID NO: 1616 - RNA, 27 nt, Artificial Sequence
  Synthetic oligonucleotide
gcaucgaaccauuagcagaaaguauac

SEQ ID NO: 1617 - RNA, 27 nt, Artificial Sequence
  Synthetic oligonucleotide
gaaccauuagcagaaaguaucacagca

SEQ ID NO: 1618 - RNA, 27 nt, Artificial Sequence
  Synthetic oligonucleotide
acgggacuggcuaguuaaacaaagaaa

SEQ ID NO: 1619 - RNA, 27 nt, Artificial Sequence
  Synthetic oligonucleotide
cgggacuggcuaguuaaacaaagagaa

SEQ ID NO: 1620 - RNA, 27 nt, Artificial Sequence
  Synthetic oligonucleotide
ggcuaguuaaacaaagaggcugggaca

SEQ ID NO: 1621 - RNA, 27 nt, Artificial Sequence
  Synthetic oligonucleotide
uuaaacaaagaggcugggauggguuca

SEQ ID NO: 1622 - RNA, 27 nt, Artificial Sequence
  Synthetic oligonucleotide
uaaacaaagaggcugggauggguuuac

SEQ ID NO: 1623 - RNA, 27 nt, Artificial Sequence
  Synthetic oligonucleotide
aaacaaagaggcugggauggguuugca

SEQ ID NO: 1624 - RNA, 27 nt, Artificial Sequence
  Synthetic oligonucleotide
aacaaagaggcugggauggguuuguaa

SEQ ID NO: 1625 - RNA, 27 nt, Artificial Sequence
  Synthetic oligonucleotide
acaaagaggcugggauggguuugugac

SEQ ID NO: 1626 - RNA, 27 nt, Artificial Sequence
  Synthetic oligonucleotide
caaagaggcugggauggguuuguggca

SEQ ID NO: 1627 - RNA, 27 nt, Artificial Sequence
  Synthetic oligonucleotide
aaagaggcugggauggguuuguggaac

SEQ ID NO: 1628 - RNA, 27 nt, Artificial Sequence
  Synthetic oligonucleotide
aagaggcugggauggguuuguggagcc

SEQ ID NO: 1629 - RNA, 27 nt, Artificial Sequence
  Synthetic oligonucleotide
agaggcugggauggguuuguggaguca

SEQ ID NO: 1630 - RNA, 27 nt, Artificial Sequence
  Synthetic oligonucleotide
gaggcugggauggguuuguggaguuac

SEQ ID NO: 1631 - RNA, 27 nt, Artificial Sequence
  Synthetic oligonucleotide
aggcugggauggguuuguggaguuccc

SEQ ID NO: 1632 - RNA, 27 nt, Artificial Sequence
  Synthetic oligonucleotide
ggcugggauggguuuguggaguucuca

SEQ ID NO: 1633 - RNA, 27 nt, Artificial Sequence
  Synthetic oligonucleotide
gcugggauggguuuguggaguucuuaa

SEQ ID NO: 1634 - RNA, 27 nt, Artificial Sequence
  Synthetic oligonucleotide
cugggauggguuuguggaguucuucac

SEQ ID NO: 1635 - RNA, 27 nt, Artificial Sequence
  Synthetic oligonucleotide
ugggauggguuuguggaguucuucccc

SEQ ID NO: 1636 - RNA, 27 nt, Artificial Sequence
  Synthetic oligonucleotide
gggauggguuuguggaguucuuccaca

SEQ ID NO: 1637 - RNA, 27 nt, Artificial Sequence
  Synthetic oligonucleotide
ggauggguuuguggaguucuuccauac

SEQ ID NO: 1638 - RNA, 27 nt, Artificial Sequence
  Synthetic oligonucleotide
gauggguuuguggaguucuuccaugcc

SEQ ID NO: 1639 - RNA, 27 nt, Artificial Sequence
  Synthetic oligonucleotide
auggguuuguggaguucuuccauguca

SEQ ID NO: 1640 - RNA, 27 nt, Artificial Sequence
  Synthetic oligonucleotide
uggguuuguggaguucuuccauguaac

SEQ ID NO: 1641 - RNA, 27 nt, Artificial Sequence
  Synthetic oligonucleotide
ggaguucuuccauguagaggaccuaac

SEQ ID NO: 1642 - RNA, 27 nt, Artificial Sequence
  Synthetic oligonucleotide
uuccauguagaggaccuagaaggugaa

SEQ ID NO: 1643 - RNA, 27 nt, Artificial Sequence
  Synthetic oligonucleotide
gaggaccuagaagguggcaucaggacc

SEQ ID NO: 1644 - RNA, 27 nt, Artificial Sequence
  Synthetic oligonucleotide
cagguguugcuggaguaggagcuggcc

SEQ ID NO: 1645 - RNA, 27 nt, Artificial Sequence
  Synthetic oligonucleotide
agcugguuuggcauaucuaauaagacc

SEQ ID NO: 1646 - RNA, 27 nt, Artificial Sequence
  Synthetic oligonucleotide
uuuggcauaucuaauaagauagccucc

SEQ ID NO: 1647 - RNA, 27 nt, Artificial Sequence
  Synthetic oligonucleotide
uuggcauaucuaauaagauagccuuca

SEQ ID NO: 1648 - RNA, 27 nt, Artificial Sequence
  Synthetic oligonucleotide
uggcauaucuaauaagauagccuuaac

SEQ ID NO: 1649 - RNA, 27 nt, Artificial Sequence
  Synthetic oligonucleotide
ggcauaucuaauaagauagccuuacca

SEQ ID NO: 1650 - RNA, 27 nt, Artificial Sequence
  Synthetic oligonucleotide
gcauaucuaauaagauagccuuacuac

SEQ ID NO: 1651 - RNA, 27 nt, Artificial Sequence
  Synthetic oligonucleotide
cauaucuaauaagauagccuuacugcc

SEQ ID NO: 1652 - RNA, 27 nt, Artificial Sequence
  Synthetic oligonucleotide
uagccuuacuguaagugcaauaguuac

SEQ ID NO: 1653 - RNA, 27 nt, Artificial Sequence
  Synthetic oligonucleotide
uuggacuccaagcuguaacuuccuaac

SEQ ID NO: 1654 - RNA, 27 nt, Artificial Sequence
  Synthetic oligonucleotide
acuuccuagaguugcacccuagcaaaa

SEQ ID NO: 1655 - RNA, 27 nt, Artificial Sequence
  Synthetic oligonucleotide
aagcaaguggcaagaggauuauggccc

SEQ ID NO: 1656 - RNA, 27 nt, Artificial Sequence
  Synthetic oligonucleotide
aguggcaagaggauuauggcuaacaca

SEQ ID NO: 1657 - RNA, 27 nt, Artificial Sequence
  Synthetic oligonucleotide
guggcaagaggauuauggcuaacaaac

SEQ ID NO: 1658 - RNA, 27 nt, Artificial Sequence
  Synthetic oligonucleotide
aagaggauuauggcuaacaagaauacc

SEQ ID NO: 1659 - RNA, 27 nt, Artificial Sequence
  Synthetic oligonucleotide
uauggcuaacaagaauaaauacaugaa

SEQ ID NO: 1660 - RNA, 27 nt, Artificial Sequence
  Synthetic oligonucleotide
auggcuaacaagaauaaauacauggac

SEQ ID NO: 1661 - RNA, 27 nt, Artificial Sequence
  Synthetic oligonucleotide
uggcuaacaagaauaaauacaugggcc

SEQ ID NO: 1662 - RNA, 27 nt, Artificial Sequence
  Synthetic oligonucleotide
ggcuaacaagaauaaauacaugggaca

SEQ ID NO: 1663 - RNA, 27 nt, Artificial Sequence
  Synthetic oligonucleotide
gcuaacaagaauaaauacaugggaaac

SEQ ID NO: 1664 - RNA, 27 nt, Artificial Sequence
  Synthetic oligonucleotide
cuaacaagaauaaauacaugggaagca

SEQ ID NO: 1665 - RNA, 27 nt, Artificial Sequence
  Synthetic oligonucleotide
uaacaagaauaaauacaugggaagaac

SEQ ID NO: 1666 - RNA, 27 nt, Artificial Sequence
  Synthetic oligonucleotide
aacaagaauaaauacaugggaagagca

SEQ ID NO: 1667 - RNA, 27 nt, Artificial Sequence
  Synthetic oligonucleotide
acaagaauaaauacaugggaagaguaa

SEQ ID NO: 1668 - RNA, 27 nt, Artificial Sequence
  Synthetic oligonucleotide
caagaauaaauacaugggaagagugac

SEQ ID NO: 1669 - RNA, 27 nt, Artificial Sequence
  Synthetic oligonucleotide
cccauugauugaagagucacugucuac

SEQ ID NO: 1670 - RNA, 27 nt, Artificial Sequence
  Synthetic oligonucleotide
cacugucugaaagaagcaaaguucaac

SEQ ID NO: 1671 - RNA, 27 nt, Artificial Sequence
  Synthetic oligonucleotide
aaacaaacuuuguuugggaagcuauaa

SEQ ID NO: 1672 - RNA, 27 nt, Artificial Sequence
  Synthetic oligonucleotide
ggaggacuuuuagauuuagugaagaca

SEQ ID NO: 1673 - RNA, 27 nt, Artificial Sequence
  Synthetic oligonucleotide
gaagaugguaggguggaaagacuuacc

SEQ ID NO: 1674 - RNA, 27 nt, Artificial Sequence
  Synthetic oligonucleotide
uccuuguugagaacaggaaaguggcac

SEQ ID NO: 1675 - RNA, 27 nt, Artificial Sequence
  Synthetic oligonucleotide
uagccaggcaagucauagaauugaucc

SEQ ID NO: 1676 - RNA, 27 nt, Artificial Sequence
  Synthetic oligonucleotide
ccaggcaagucauagaauugauuacaa

SEQ ID NO: 1677 - RNA, 27 nt, Artificial Sequence
  Synthetic oligonucleotide
caggcaagucauagaauugauuaccaa

SEQ ID NO: 1678 - RNA, 27 nt, Artificial Sequence
  Synthetic oligonucleotide
uacccgccgaauucauuaauuuacuac

SEQ ID NO: 1679 - RNA, 27 nt, Artificial Sequence
  Synthetic oligonucleotide
gccgaauucauuaauuuacuguaguac

SEQ ID NO: 1680 - RNA, 27 nt, Artificial Sequence
  Synthetic oligonucleotide
uaguguuaagagaagcacuaagaauaa

SEQ ID NO: 1681 - RNA, 27 nt, Artificial Sequence
  Synthetic oligonucleotide
gaagcacuaagaaugccagugaccuac

SEQ ID NO: 1682 - RNA, 27 nt, Artificial Sequence
  Synthetic oligonucleotide
acaaguaauagaacuaugacuguaaaa

SEQ ID NO: 1683 - RNA, 27 nt, Artificial Sequence
  Synthetic oligonucleotide
aaguaauagaacuaugacuguaagcac

SEQ ID NO: 1684 - RNA, 27 nt, Artificial Sequence
  Synthetic oligonucleotide
gccucaguacuguacaagggaagcucc

SEQ ID NO: 1685 - RNA, 27 nt, Artificial Sequence
  Synthetic oligonucleotide
ucccaguauacuucuuagaaagucccc

SEQ ID NO: 1686 - RNA, 27 nt, Artificial Sequence
  Synthetic oligonucleotide
uaccuguuauacuuuggcuugguuuaa

SEQ ID NO: 1687 - RNA, 27 nt, Artificial Sequence
  Synthetic oligonucleotide
agccuaguuuaucaccaauaauacuca

SEQ ID NO: 1688 - RNA, 27 nt, Artificial Sequence
  Synthetic oligonucleotide
aucaccaauaauacuugacggaaggac

SEQ ID NO: 1689 - RNA, 27 nt, Artificial Sequence
  Synthetic oligonucleotide
ucaccaauaauacuugacggaaggcca

SEQ ID NO: 1690 - RNA, 27 nt, Artificial Sequence
  Synthetic oligonucleotide
caccaauaauacuugacggaaggcuac

SEQ ID NO: 1691 - RNA, 27 nt, Artificial Sequence
  Synthetic oligonucleotide
aaggcucaguaauuaguuaugaauaca

SEQ ID NO: 1692 - RNA, 27 nt, Artificial Sequence
  Synthetic oligonucleotide
cucaguaauuaguuaugaauauggacc

SEQ ID NO: 1693 - RNA, 27 nt, Artificial Sequence
  Synthetic oligonucleotide
auucuuaagacagcuuguaaauguacc

SEQ ID NO: 1694 - RNA, 27 nt, Artificial Sequence
  Synthetic oligonucleotide
uguaaaaauuguauauauuuuuacaac

SEQ ID NO: 1695 - RNA, 27 nt, Artificial Sequence
  Synthetic oligonucleotide
uuuacagaaagucuauuucuuugaaca

SEQ ID NO: 1696 - RNA, 27 nt, Artificial Sequence
  Synthetic oligonucleotide
uuacagaaagucuauuucuuugaaaaa

SEQ ID NO: 1697 - RNA, 27 nt, Artificial Sequence
  Synthetic oligonucleotide
uacagaaagucuauuucuuugaaacac

SEQ ID NO: 1698 - RNA, 27 nt, Artificial Sequence
  Synthetic oligonucleotide
acagaaagucuauuucuuugaaacgcc

SEQ ID NO: 1699 - RNA, 27 nt, Artificial Sequence
  Synthetic oligonucleotide
cagaaagucuauuucuuugaaacgaca

SEQ ID NO: 1700 - RNA, 27 nt, Artificial Sequence
  Synthetic oligonucleotide
aacgaaggaaguaucgaauuuacaucc

SEQ ID NO: 1701 - RNA, 27 nt, Artificial Sequence
  Synthetic oligonucleotide
aucgaauuuacauuaguuuuuuucacc

SEQ ID NO: 1702 - RNA, 27 nt, Artificial Sequence
  Synthetic oligonucleotide
gaacuuugcaacuuccguaauuaggcc

SEQ ID NO: 1703 - RNA, 27 nt, Artificial Sequence
  Synthetic oligonucleotide
agaguguauacagaacgaauugaugca

SEQ ID NO: 1704 - RNA, 27 nt, Artificial Sequence
  Synthetic oligonucleotide
guggaacaaaucugauaacuaugcaaa

SEQ ID NO: 1705 - RNA, 27 nt, Artificial Sequence
  Synthetic oligonucleotide
aaauuuucuuaucugauuuugguaaac

SEQ ID NO: 1706 - RNA, 27 nt, Artificial Sequence
  Synthetic oligonucleotide
uagguuuuucuuugaaaaccugggacc

SEQ ID NO: 1707 - RNA, 27 nt, Artificial Sequence
  Synthetic oligonucleotide
cugggauugagagguugaugaauggcc

SEQ ID NO: 1708 - RNA, 27 nt, Artificial Sequence
  Synthetic oligonucleotide
ugagagguugaugaauggaaauucucc

SEQ ID NO: 1709 - RNA, 27 nt, Artificial Sequence
  Synthetic oligonucleotide
agguugaugaauggaaauucuuucaac

SEQ ID NO: 1710 - RNA, 27 nt, Artificial Sequence
  Synthetic oligonucleotide
uauaugcaaguuuucaauaauuaggca

SEQ ID NO: 1711 - RNA, 27 nt, Artificial Sequence
  Synthetic oligonucleotide
aagguuacugaugacuuacaaauaaca

SEQ ID NO: 1712 - RNA, 27 nt, Artificial Sequence
  Synthetic oligonucleotide
auugggcaauacucauuugaguucccc

SEQ ID NO: 1713 - RNA, 27 nt, Artificial Sequence
  Synthetic oligonucleotide
uuccauuugaccuaauuuaacugguac

SEQ ID NO: 1714 - RNA, 27 nt, Artificial Sequence
  Synthetic oligonucleotide
uuaaagcuuuuacuaaaagauuuucca

SEQ ID NO: 1715 - RNA, 27 nt, Artificial Sequence
  Synthetic oligonucleotide
cagguggauggagagacauuugaucaa

SEQ ID NO: 1716 - RNA, 27 nt, Artificial Sequence
  Synthetic oligonucleotide
ugcuuaauaaauuauaaaaugauggac

SEQ ID NO: 1717 - RNA, 27 nt, Artificial Sequence
  Synthetic oligonucleotide
uaaccauggugcuauuauuaggcuuaa

SEQ ID NO: 1718 - RNA, 27 nt, Artificial Sequence
  Synthetic oligonucleotide
uaagccuaguaugucaauaaagcaacc

SEQ ID NO: 1719 - RNA, 27 nt, Artificial Sequence
  Synthetic oligonucleotide
uacuguuuuguuucuauuaaugauuaa

SEQ ID NO: 1720 - RNA, 27 nt, Artificial Sequence
  Synthetic oligonucleotide
uucuauuaaugauucccaaaccuugcc

SEQ ID NO: 1721 - RNA, 27 nt, Artificial Sequence
  Synthetic oligonucleotide
cuuguugcaaguuuuugcauuggcaca

SEQ ID NO: 1722 - RNA, 27 nt, Artificial Sequence
  Synthetic oligonucleotide
uuggauuucagucuugauguuuguuac

SEQ ID NO: 1723 - RNA, 27 nt, Artificial Sequence
  Synthetic oligonucleotide
cuuccuugaaauugcugauuguucuaa

SEQ ID NO: 1724 - RNA, 27 nt, Artificial Sequence
  Synthetic oligonucleotide
gcucccucuacagauauuuauaucacc

SEQ ID NO: 1725 - RNA, 27 nt, Artificial Sequence
  Synthetic oligonucleotide
ccaccaagaguccacagaccuuucaca

SEQ ID NO: 1726 - RNA, 27 nt, Artificial Sequence
  Synthetic oligonucleotide
caccaagaguccacagaccuuucauac

SEQ ID NO: 1727 - RNA, 27 nt, Artificial Sequence
  Synthetic oligonucleotide
gaguccacagaccuuucaucuuucaaa

SEQ ID NO: 1728 - RNA, 27 nt, Artificial Sequence
  Synthetic oligonucleotide
aguccacagaccuuucaucuuucacac

SEQ ID NO: 1729 - RNA, 27 nt, Artificial Sequence
  Synthetic oligonucleotide
guccacagaccuuucaucuuucacgcc

SEQ ID NO: 1730 - RNA, 27 nt, Artificial Sequence
  Synthetic oligonucleotide
uccacagaccuuucaucuuucacgaca

SEQ ID NO: 1731 - RNA, 27 nt, Artificial Sequence
  Synthetic oligonucleotide
acagaccuuucaucuuucacgaacuca

SEQ ID NO: 1732 - RNA, 27 nt, Artificial Sequence
  Synthetic oligonucleotide
gaccuuucaucuuucacgaacuugaca

SEQ ID NO: 1733 - RNA, 27 nt, Artificial Sequence
  Synthetic oligonucleotide
cugugacacuaacagucauugagagac

SEQ ID NO: 1734 - RNA, 27 nt, Artificial Sequence
  Synthetic oligonucleotide
cacuaacagucauugagaggugggaaa

SEQ ID NO: 1735 - RNA, 27 nt, Artificial Sequence
  Synthetic oligonucleotide
uaggaguaugcucacuuaaauuuacca

SEQ ID NO: 1736 - RNA, 27 nt, Artificial Sequence
  Synthetic oligonucleotide
gcucacuuaaauuuacagaaagaggca

SEQ ID NO: 1737 - RNA, 27 nt, Artificial Sequence
  Synthetic oligonucleotide
cacuuaaauuuacagaaagaggugaaa

SEQ ID NO: 1738 - RNA, 27 nt, Artificial Sequence
  Synthetic oligonucleotide
aaacugaagaaagugucuauauuggcc

SEQ ID NO: 1739 - RNA, 27 nt, Artificial Sequence
  Synthetic oligonucleotide
uuggaacuagggucauuugaaagcuca

SEQ ID NO: 1740 - RNA, 27 nt, Artificial Sequence
  Synthetic oligonucleotide
aacuagggucauuugaaagcuucagca

SEQ ID NO: 1741 - RNA, 27 nt, Artificial Sequence
  Synthetic oligonucleotide
acuagggucauuugaaagcuucaguac

SEQ ID NO: 1742 - RNA, 27 nt, Artificial Sequence
  Synthetic oligonucleotide
cuagggucauuugaaagcuucagucca

SEQ ID NO: 1743 - RNA, 27 nt, Artificial Sequence
  Synthetic oligonucleotide
uagggucauuugaaagcuucagucuaa

SEQ ID NO: 1744 - RNA, 27 nt, Artificial Sequence
  Synthetic oligonucleotide
agggucauuugaaagcuucagucucaa

SEQ ID NO: 1745 - RNA, 27 nt, Artificial Sequence
  Synthetic oligonucleotide
ucagucucggaacaugaccuuuaguac

SEQ ID NO: 1746 - RNA, 27 nt, Artificial Sequence
  Synthetic oligonucleotide
cggaacaugaccuuuagucuguggaac

SEQ ID NO: 1747 - RNA, 27 nt, Artificial Sequence
  Synthetic oligonucleotide
gaacaugaccuuuagucuguggacuaa

SEQ ID NO: 1748 - RNA, 27 nt, Artificial Sequence
  Synthetic oligonucleotide
uccauuuaaaaauagguaugaauaaac

SEQ ID NO: 1749 - RNA, 27 nt, Artificial Sequence
  Synthetic oligonucleotide
uagguaugaauaagaugacuaagaaca

SEQ ID NO: 1750 - RNA, 27 nt, Artificial Sequence
  Synthetic oligonucleotide
cugcccaucucagagccauaagguccc

SEQ ID NO: 1751 - RNA, 27 nt, Artificial Sequence
  Synthetic oligonucleotide
uuaccuauguauuuaucguucuugaca

SEQ ID NO: 1752 - RNA, 27 nt, Artificial Sequence
  Synthetic oligonucleotide
aagccgcuuauuuauaucauguaucca

SEQ ID NO: 1753 - RNA, 27 nt, Artificial Sequence
  Synthetic oligonucleotide
auguaguuuuuaauuaaucuuaagaca

SEQ ID NO: 1754 - RNA, 27 nt, Artificial Sequence
  Synthetic oligonucleotide
agccugucugccaaauccaguggaaca

SEQ ID NO: 1755 - RNA, 27 nt, Artificial Sequence
  Synthetic oligonucleotide
ucugccaaauccaguggaaacaaguaa

SEQ ID NO: 1756 - RNA, 27 nt, Artificial Sequence
  Synthetic oligonucleotide
ccaguggaaacaagugcauagauguac

SEQ ID NO: 1757 - RNA, 27 nt, Artificial Sequence
  Synthetic oligonucleotide
guggaaacaagugcauagaugugaacc

SEQ ID NO: 1758 - RNA, 27 nt, Artificial Sequence
  Synthetic oligonucleotide
ccacuucccaauucauuagguaugaac

SEQ ID NO: 1759 - RNA, 27 nt, Artificial Sequence
  Synthetic oligonucleotide
uagguaugacuguggaaauacagaccc

SEQ ID NO: 1760 - RNA, 27 nt, Artificial Sequence
  Synthetic oligonucleotide
augacuguggaaauacagacaaggaca

SEQ ID NO: 1761 - RNA, 27 nt, Artificial Sequence
  Synthetic oligonucleotide
ugacuguggaaauacagacaaggauac

SEQ ID NO: 1762 - RNA, 27 nt, Artificial Sequence
  Synthetic oligonucleotide
acuguggaaauacagacaaggaucucc

SEQ ID NO: 1763 - RNA, 27 nt, Artificial Sequence
  Synthetic oligonucleotide
cuguggaaauacagacaaggaucuuca

SEQ ID NO: 1764 - RNA, 27 nt, Artificial Sequence
  Synthetic oligonucleotide
uguggaaauacagacaaggaucuuaac

SEQ ID NO: 1765 - RNA, 27 nt, Artificial Sequence
  Synthetic oligonucleotide
guggaaauacagacaaggaucuuagcc

SEQ ID NO: 1766 - RNA, 27 nt, Artificial Sequence
  Synthetic oligonucleotide
uggaaauacagacaaggaucuuaguca

SEQ ID NO: 1767 - RNA, 27 nt, Artificial Sequence
  Synthetic oligonucleotide
gaggaggaggcagguggucuaagugac

SEQ ID NO: 1768 - RNA, 27 nt, Artificial Sequence
  Synthetic oligonucleotide
uggcuacguaguucgggcaaauccuaa

SEQ ID NO: 1769 - RNA, 27 nt, Artificial Sequence
  Synthetic oligonucleotide
ggaggauuugcuuagaaggauggcgac

SEQ ID NO: 1770 - RNA, 27 nt, Artificial Sequence
  Synthetic oligonucleotide
gaggauuugcuuagaaggauggcgcca

SEQ ID NO: 1771 - RNA, 27 nt, Artificial Sequence
  Synthetic oligonucleotide
guccucuaguguuucauguacauucca

SEQ ID NO: 1772 - RNA, 27 nt, Artificial Sequence
  Synthetic oligonucleotide
gaacaccuugguucugguuaaacagac

SEQ ID NO: 1773 - RNA, 27 nt, Artificial Sequence
  Synthetic oligonucleotide
auagcugugccaggaaggguuaggaaa

SEQ ID NO: 1774 - RNA, 27 nt, Artificial Sequence
  Synthetic oligonucleotide
ccaggaaggguuaggaccaacuacacc

SEQ ID NO: 1775 - RNA, 27 nt, Artificial Sequence
  Synthetic oligonucleotide
aggguuaggaccaacuacaaauuaaca

SEQ ID NO: 1776 - RNA, 27 nt, Artificial Sequence
  Synthetic oligonucleotide
agggaacggccuuccucacuccugaac

SEQ ID NO: 1777 - RNA, 27 nt, Artificial Sequence
  Synthetic oligonucleotide
cugcggagaaacgcggucaucggcuca

SEQ ID NO: 1778 - RNA, 27 nt, Artificial Sequence
  Synthetic oligonucleotide
ccggaggaggaacuggacggcugcgca

SEQ ID NO: 1779 - RNA, 27 nt, Artificial Sequence
  Synthetic oligonucleotide
cgaggaggaagaggacgaccuauacaa

SEQ ID NO: 1780 - RNA, 27 nt, Artificial Sequence
  Synthetic oligonucleotide
gaggaggaagaggacgaccuauaccaa

SEQ ID NO: 1781 - RNA, 27 nt, Artificial Sequence
  Synthetic oligonucleotide
aggaggaagaggacgaccuauaccgaa

SEQ ID NO: 1782 - RNA, 27 nt, Artificial Sequence
  Synthetic oligonucleotide
gaggaagaggacgaccuauaccgccca

SEQ ID NO: 1783 - RNA, 27 nt, Artificial Sequence
  Synthetic oligonucleotide
caggauugugacucuuauuucuuucaa

SEQ ID NO: 1784 - RNA, 27 nt, Artificial Sequence
  Synthetic oligonucleotide
uguggccaaacacuuaaagagcguacc

SEQ ID NO: 1785 - RNA, 27 nt, Artificial Sequence
  Synthetic oligonucleotide
guggccaaacacuuaaagagcguaaca

SEQ ID NO: 1786 - RNA, 27 nt, Artificial Sequence
  Synthetic oligonucleotide
uggccaaacacuuaaagagcguaaaaa

SEQ ID NO: 1787 - RNA, 27 nt, Artificial Sequence
  Synthetic oligonucleotide
aaagagcguaaaccaagaaagcuuccc

SEQ ID NO: 1788 - RNA, 27 nt, Artificial Sequence
  Synthetic oligonucleotide
cgaaccauuagcagaaacuaucacaac

SEQ ID NO: 1789 - RNA, 27 nt, Artificial Sequence
  Synthetic oligonucleotide
uuagcagaaacuaucacagauguuccc

SEQ ID NO: 1790 - RNA, 27 nt, Artificial Sequence
  Synthetic oligonucleotide
acgggacuggcuugucaaacaaagaaa

SEQ ID NO: 1791 - RNA, 27 nt, Artificial Sequence
  Synthetic oligonucleotide
cgggacuggcuugucaaacaaagagaa

SEQ ID NO: 1792 - RNA, 27 nt, Artificial Sequence
  Synthetic oligonucleotide
uuguggaguucuuccacguacaggaaa

SEQ ID NO: 1793 - RNA, 27 nt, Artificial Sequence
  Synthetic oligonucleotide
ggaguucuuccacguacaggaccuaac

SEQ ID NO: 1794 - RNA, 27 nt, Artificial Sequence
  Synthetic oligonucleotide
uuccacguacaggaccuagaaggcgaa

SEQ ID NO: 1795 - RNA, 27 nt, Artificial Sequence
  Synthetic oligonucleotide
cuggucuggcauaucuaauaagauaaa

SEQ ID NO: 1796 - RNA, 27 nt, Artificial Sequence
  Synthetic oligonucleotide
agccaccaaacuacaugcaucugugcc

SEQ ID NO: 1797 - RNA, 27 nt, Artificial Sequence
  Synthetic oligonucleotide
cauguguauuuaugaagguggacuuac

SEQ ID NO: 1798 - RNA, 27 nt, Artificial Sequence
  Synthetic oligonucleotide
uguguauuuaugaagguggacuugaca

SEQ ID NO: 1799 - RNA, 27 nt, Artificial Sequence
  Synthetic oligonucleotide
guauuuaugaagguggacuugaagcca

SEQ ID NO: 1800 - RNA, 27 nt, Artificial Sequence
  Synthetic oligonucleotide
guccaguucuacuguagcaacauagac

SEQ ID NO: 1801 - RNA, 27 nt, Artificial Sequence
  Synthetic oligonucleotide
cccuggaagagucacugucugaaugcc

SEQ ID NO: 1802 - RNA, 27 nt, Artificial Sequence
  Synthetic oligonucleotide
ccuggaagagucacugucugaaugaca

SEQ ID NO: 1803 - RNA, 27 nt, Artificial Sequence
  Synthetic oligonucleotide
cuggaagagucacugucugaaugaaaa

SEQ ID NO: 1804 - RNA, 27 nt, Artificial Sequence
  Synthetic oligonucleotide
cacugucugaaugaagcaaaguuccac

SEQ ID NO: 1805 - RNA, 27 nt, Artificial Sequence
  Synthetic oligonucleotide
uucccucucagcaaacacugagaggaa

SEQ ID NO: 1806 - RNA, 27 nt, Artificial Sequence
  Synthetic oligonucleotide
ucccucucagcaaacacugagaggcac

SEQ ID NO: 1807 - RNA, 27 nt, Artificial Sequence
  Synthetic oligonucleotide
ucagcaaacacugagaggccauggaac

SEQ ID NO: 1808 - RNA, 27 nt, Artificial Sequence
  Synthetic oligonucleotide
aacacugagaggccauggagaaggaac

SEQ ID NO: 1809 - RNA, 27 nt, Artificial Sequence
  Synthetic oligonucleotide
gaggccauggagaaggacuucuagacc

SEQ ID NO: 1810 - RNA, 27 nt, Artificial Sequence
  Synthetic oligonucleotide
aggccauggagaaggacuucuagaaca

SEQ ID NO: 1811 - RNA, 27 nt, Artificial Sequence
  Synthetic oligonucleotide
uggagaaggacuucuagaaugaaugcc

SEQ ID NO: 1812 - RNA, 27 nt, Artificial Sequence
  Synthetic oligonucleotide
gaaggacuucuagaaugaaugaaagaa

SEQ ID NO: 1813 - RNA, 27 nt, Artificial Sequence
  Synthetic oligonucleotide
guggauggaaagguuugauuuccuaca

SEQ ID NO: 1814 - RNA, 27 nt, Artificial Sequence
  Synthetic oligonucleotide
ccagucaucaggcuagucacaaagcca

SEQ ID NO: 1815 - RNA, 27 nt, Artificial Sequence
  Synthetic oligonucleotide
cagucaucaggcuagucacaaagcuac

SEQ ID NO: 1816 - RNA, 27 nt, Artificial Sequence
  Synthetic oligonucleotide
aggcuagucacaaagcucaauaaaucc

SEQ ID NO: 1817 - RNA, 27 nt, Artificial Sequence
  Synthetic oligonucleotide
aagcccuaauuaacaacguuggugaac

SEQ ID NO: 1818 - RNA, 27 nt, Artificial Sequence
  Synthetic oligonucleotide
aaccuacaagucaccaaacgaugaccc

SEQ ID NO: 1819 - RNA, 27 nt, Artificial Sequence
  Synthetic oligonucleotide
accuacaagucaccaaacgaugacuca

SEQ ID NO: 1820 - RNA, 27 nt, Artificial Sequence
  Synthetic oligonucleotide
agucaccaaacgaugacuagaagcuaa

SEQ ID NO: 1821 - RNA, 27 nt, Artificial Sequence
  Synthetic oligonucleotide
gucaccaaacgaugacuagaagcugac

SEQ ID NO: 1822 - RNA, 27 nt, Artificial Sequence
  Synthetic oligonucleotide
ucaccaaacgaugacuagaagcugcca

SEQ ID NO: 1823 - RNA, 27 nt, Artificial Sequence
  Synthetic oligonucleotide
caccaaacgaugacuagaagcugcaac

SEQ ID NO: 1824 - RNA, 27 nt, Artificial Sequence
  Synthetic oligonucleotide
caggaaugugaagggaggccucugaaa

SEQ ID NO: 1825 - RNA, 27 nt, Artificial Sequence
  Synthetic oligonucleotide
ugugcuugacaaagucccaagugcuac

SEQ ID NO: 1826 - RNA, 27 nt, Artificial Sequence
  Synthetic oligonucleotide
gugcuugacaaagucccaagugcucca

SEQ ID NO: 1827 - RNA, 27 nt, Artificial Sequence
  Synthetic oligonucleotide
uugacaaagucccaagugcucaggaac

SEQ ID NO: 1828 - RNA, 27 nt, Artificial Sequence
  Synthetic oligonucleotide
agcccugucuacuuuggcuugguuuaa

SEQ ID NO: 1829 - RNA, 27 nt, Artificial Sequence
  Synthetic oligonucleotide
uucuuaaguuuauuagccuagugauaa

SEQ ID NO: 1830 - RNA, 27 nt, Artificial Sequence
  Synthetic oligonucleotide
aaaguacuugacuuaagguucacuacc

SEQ ID NO: 1831 - RNA, 27 nt, Artificial Sequence
  Synthetic oligonucleotide
gaacauaagagggaagucuuggauucc

SEQ ID NO: 1832 - RNA, 27 nt, Artificial Sequence
  Synthetic oligonucleotide
cagcuucucuaguuagaaauguauuca

SEQ ID NO: 1833 - RNA, 27 nt, Artificial Sequence
  Synthetic oligonucleotide
ugucauccguucuaguguauaugcaac

SEQ ID NO: 1834 - RNA, 27 nt, Artificial Sequence
  Synthetic oligonucleotide
uguguguggacugguuauagauuuacc

SEQ ID NO: 1835 - RNA, 27 nt, Artificial Sequence
  Synthetic oligonucleotide
uaacuaugcaggguuaauuauccaaca

SEQ ID NO: 1836 - RNA, 27 nt, Artificial Sequence
  Synthetic oligonucleotide
aucacagguagauagauguaagacacc

SEQ ID NO: 1837 - RNA, 27 nt, Artificial Sequence
  Synthetic oligonucleotide
agguagauagauguaagacauuugaca

SEQ ID NO: 1838 - RNA, 27 nt, Artificial Sequence
  Synthetic oligonucleotide
guaaaugguaaagcaggcuagaguccc

SEQ ID NO: 1839 - RNA, 27 nt, Artificial Sequence
  Synthetic oligonucleotide
auggugcuauucacuggguuuacuuac

SEQ ID NO: 1840 - RNA, 27 nt, Artificial Sequence
  Synthetic oligonucleotide
uuucuugucuacuaaggauugccaaaa

SEQ ID NO: 1841 - RNA, 27 nt, Artificial Sequence
  Synthetic oligonucleotide
uggucucuagguguagccuuuacuuaa

SEQ ID NO: 1842 - RNA, 27 nt, Artificial Sequence
  Synthetic oligonucleotide
cccuauagagucgucuacacuuccuaa

SEQ ID NO: 1843 - RNA, 27 nt, Artificial Sequence
  Synthetic oligonucleotide
gucgucuacacuuccucccugugcuac

SEQ ID NO: 1844 - RNA, 27 nt, Artificial Sequence
  Synthetic oligonucleotide
uaguuaucugcauuagaacucucacaa

SEQ ID NO: 1845 - RNA, 27 nt, Artificial Sequence
  Synthetic oligonucleotide
auccuaaucagagucagcacagcuuca

SEQ ID NO: 1846 - RNA, 27 nt, Artificial Sequence
  Synthetic oligonucleotide
acagcuuuccugucagaggauaggaca

SEQ ID NO: 1847 - RNA, 27 nt, Artificial Sequence
  Synthetic oligonucleotide
uuccugucagaggauaggaacacuuaa

SEQ ID NO: 1848 - RNA, 27 nt, Artificial Sequence
  Synthetic oligonucleotide
cugucagaggauaggaacacuugcuac

SEQ ID NO: 1849 - RNA, 27 nt, Artificial Sequence
  Synthetic oligonucleotide
ugucagaggauaggaacacuugcuccc

SEQ ID NO: 1850 - RNA, 27 nt, Artificial Sequence
  Synthetic oligonucleotide
gaccgacagugaccagggauuggcacc

SEQ ID NO: 1851 - RNA, 27 nt, Artificial Sequence
  Synthetic oligonucleotide
caugcuuuccauuguuacuuugucucc

SEQ ID NO: 1852 - RNA, 27 nt, Artificial Sequence
  Synthetic oligonucleotide
aagguuggaaauuauacguuuauaccc

SEQ ID NO: 1853 - RNA, 27 nt, Artificial Sequence
  Synthetic oligonucleotide
uuauuaguuugcuccaaguaugacuac

SEQ ID NO: 1854 - RNA, 27 nt, Artificial Sequence
  Synthetic oligonucleotide
uucacuuaaguuuagagaaacacugaa

SEQ ID NO: 1855 - RNA, 27 nt, Artificial Sequence
  Synthetic oligonucleotide
ccacugguaacugaagguauuuaagac

SEQ ID NO: 1856 - RNA, 27 nt, Artificial Sequence
  Synthetic oligonucleotide
cagccucagaaugugaccuuuagucca

SEQ ID NO: 1857 - RNA, 27 nt, Artificial Sequence
  Synthetic oligonucleotide
aauaggcaggaaucaaaugacuaagcc

SEQ ID NO: 1858 - RNA, 27 nt, Artificial Sequence
  Synthetic oligonucleotide
auaggcaggaaucaaaugacuaagacc

SEQ ID NO: 1859 - RNA, 27 nt, Artificial Sequence
  Synthetic oligonucleotide
uaggcaggaaucaaaugacuaagaaca

SEQ ID NO: 1860 - RNA, 27 nt, Artificial Sequence
  Synthetic oligonucleotide
aggcaggaaucaaaugacuaagaauac

SEQ ID NO: 1861 - RNA, 27 nt, Artificial Sequence
  Synthetic oligonucleotide
ggcaggaaucaaaugacuaagaaugcc

SEQ ID NO: 1862 - RNA, 27 nt, Artificial Sequence
  Synthetic oligonucleotide
gcaggaaucaaaugacuaagaaugucc

SEQ ID NO: 1863 - RNA, 27 nt, Artificial Sequence
  Synthetic oligonucleotide
caggaaucaaaugacuaagaauguacc

SEQ ID NO: 1864 - RNA, 27 nt, Artificial Sequence
  Synthetic oligonucleotide
aggaaucaaaugacuaagaauguaacc

SEQ ID NO: 1865 - RNA, 27 nt, Artificial Sequence
  Synthetic oligonucleotide
augacuaagaauguaauagggaagaca

SEQ ID NO: 1866 - RNA, 27 nt, Artificial Sequence
  Synthetic oligonucleotide
cugccagcuugggagugauuuguacac

SEQ ID NO: 1867 - RNA, 27 nt, Artificial Sequence
  Synthetic oligonucleotide
auccuugaucauaguuugcuuauuucc

SEQ ID NO: 1868 - RNA, 27 nt, Artificial Sequence
  Synthetic oligonucleotide
agagcacuuuauguaguugaauaaaaa

SEQ ID NO: 1869 - RNA, 27 nt, Artificial Sequence
  Synthetic oligonucleotide
gagcacuuuauguaguugaauaaacaa

SEQ ID NO: 1870 - RNA, 27 nt, Artificial Sequence
  Synthetic oligonucleotide
uuuguuuacuaggagccugacuuccac

SEQ ID NO: 1871 - RNA, 27 nt, Artificial Sequence
  Synthetic oligonucleotide
agccugacuucccagcucacaaaggac

SEQ ID NO: 1872 - RNA, 27 nt, Artificial Sequence
  Synthetic oligonucleotide
gccugacuucccagcucacaaagggca

SEQ ID NO: 1873 - RNA, 27 nt, Artificial Sequence
  Synthetic oligonucleotide
ccugacuucccagcucacaaaggguac

SEQ ID NO: 1874 - RNA, 27 nt, Artificial Sequence
  Synthetic oligonucleotide
ucccagcucacaaagggugaaaugacc

SEQ ID NO: 1875 - RNA, 27 nt, Artificial Sequence
  Synthetic oligonucleotide
agcucacaaagggugaaaugaaagcca

SEQ ID NO: 1876 - RNA, 27 nt, Artificial Sequence
  Synthetic oligonucleotide
gcugaaguacagacaggaucuuaguca

SEQ ID NO: 1877 - RNA, 27 nt, Artificial Sequence
  Synthetic oligonucleotide
gaaguacagacaggaucuuaguaggcc

SEQ ID NO: 1878 - RNA, 27 nt, Artificial Sequence
  Synthetic oligonucleotide
gggccaugaagacuuggagagcgcaac

SEQ ID NO: 1879 - RNA, 27 nt, Artificial Sequence
  Synthetic oligonucleotide
cuuuggagggaagaagcauguggucca

SEQ ID NO: 1880 - RNA, 27 nt, Artificial Sequence
  Synthetic oligonucleotide
ugagugcugacuagaugaauaguugca

SEQ ID NO: 1881 - RNA, 27 nt, Artificial Sequence
  Synthetic oligonucleotide
gcugacuagaugaauaguugaggcaac

SEQ ID NO: 1882 - RNA, 27 nt, Artificial Sequence
  Synthetic oligonucleotide
ugaggcacauccuucagagaagaggac

SEQ ID NO: 1883 - RNA, 27 nt, Artificial Sequence
  Synthetic oligonucleotide
gaggcacauccuucagagaagagggca

SEQ ID NO: 1884 - RNA, 27 nt, Artificial Sequence
  Synthetic oligonucleotide
gggcugcuuggaaagauggcucucaaa

SEQ ID NO: 1885 - RNA, 27 nt, Artificial Sequence
  Synthetic oligonucleotide
aaucuguuugucuuacacgucucucca

SEQ ID NO: 1886 - RNA, 27 nt, Artificial Sequence
  Synthetic oligonucleotide
caagcaucuuccauguacauucuauac

SEQ ID NO: 1887 - RNA, 27 nt, Artificial Sequence
  Synthetic oligonucleotide
gagcaccuaacacuuuaacagcuguca

SEQ ID NO: 1888 - RNA, 27 nt, Artificial Sequence
  Synthetic oligonucleotide
acagcuguucccgaaaggguuaggaaa

SEQ ID NO: 1889 - RNA, 27 nt, Artificial Sequence
  Synthetic oligonucleotide
cccgaaaggguuaggaccaacugcaca

SEQ ID NO: 1890 - RNA, 27 nt, Artificial Sequence
  Synthetic oligonucleotide
gaccaacugcaaguuaauguggguuac

SEQ ID NO: 1891 - RNA, 27 nt, Artificial Sequence
  Synthetic oligonucleotide
ucgccacuucucacuuccgcuuccuuc

SEQ ID NO: 1892 - RNA, 27 nt, Artificial Sequence
  Synthetic oligonucleotide
ccacuucucacuuccgcuuccuuccag

SEQ ID NO: 1893 - RNA, 27 nt, Artificial Sequence
  Synthetic oligonucleotide
gcggcggcgacuggcaauguuuggccu

SEQ ID NO: 1894 - RNA, 27 nt, Artificial Sequence
  Synthetic oligonucleotide
aacgcgguaaucggacucaaccucuac

SEQ ID NO: 1895 - RNA, 27 nt, Artificial Sequence
  Synthetic oligonucleotide
ggagggcgacuuuuggcuacggagaag

SEQ ID NO: 1896 - RNA, 27 nt, Artificial Sequence
  Synthetic oligonucleotide
ccgcgaggcugcuuuucuucgcgccca

SEQ ID NO: 1897 - RNA, 27 nt, Artificial Sequence
  Synthetic oligonucleotide
ucugguaauaacaccaguacggacggg

SEQ ID NO: 1898 - RNA, 27 nt, Artificial Sequence
  Synthetic oligonucleotide
gaggaggaggacgaguuguaccggcag

SEQ ID NO: 1899 - RNA, 27 nt, Artificial Sequence
  Synthetic oligonucleotide
accggcagucgcuggagauuaucucuc

SEQ ID NO: 1900 - RNA, 27 nt, Artificial Sequence
  Synthetic oligonucleotide
gccaaggacacaaagccaaugggcagg

SEQ ID NO: 1901 - RNA, 27 nt, Artificial Sequence
  Synthetic oligonucleotide
caggaaggcgcuggagaccuuacgacg

SEQ ID NO: 1902 - RNA, 27 nt, Artificial Sequence
  Synthetic oligonucleotide
auggcgugcagcgcaaccacgagacgg

SEQ ID NO: 1903 - RNA, 27 nt, Artificial Sequence
  Synthetic oligonucleotide
uggcgugcagcgcaaccacgagacggc

SEQ ID NO: 1904 - RNA, 27 nt, Artificial Sequence
  Synthetic oligonucleotide
ggcgugcagcgcaaccacgagacggcc

SEQ ID NO: 1905 - RNA, 27 nt, Artificial Sequence
  Synthetic oligonucleotide
gcgugcagcgcaaccacgagacggccu

SEQ ID NO: 1906 - RNA, 27 nt, Artificial Sequence
  Synthetic oligonucleotide
cgugcagcgcaaccacgagacggccuu

SEQ ID NO: 1907 - RNA, 27 nt, Artificial Sequence
  Synthetic oligonucleotide
gugcagcgcaaccacgagacggccuuc

SEQ ID NO: 1908 - RNA, 27 nt, Artificial Sequence
  Synthetic oligonucleotide
ugcagcgcaaccacgagacggccuucc

SEQ ID NO: 1909 - RNA, 27 nt, Artificial Sequence
  Synthetic oligonucleotide
gcagcgcaaccacgagacggccuucca

SEQ ID NO: 1910 - RNA, 27 nt, Artificial Sequence
  Synthetic oligonucleotide
cagcgcaaccacgagacggccuuccaa

SEQ ID NO: 1911 - RNA, 27 nt, Artificial Sequence
  Synthetic oligonucleotide
agcgcaaccacgagacggccuuccaag

SEQ ID NO: 1912 - RNA, 27 nt, Artificial Sequence
  Synthetic oligonucleotide
gcgcaaccacgagacggccuuccaagg

SEQ ID NO: 1913 - RNA, 27 nt, Artificial Sequence
  Synthetic oligonucleotide
cgcaaccacgagacggccuuccaaggc

SEQ ID NO: 1914 - RNA, 27 nt, Artificial Sequence
  Synthetic oligonucleotide
gcaaccacgagacggccuuccaaggca

SEQ ID NO: 1915 - RNA, 27 nt, Artificial Sequence
  Synthetic oligonucleotide
caaccacgagacggccuuccaaggcau

SEQ ID NO: 1916 - RNA, 27 nt, Artificial Sequence
  Synthetic oligonucleotide
uuccaaggcaugcuucggaaacuggac

SEQ ID NO: 1917 - RNA, 27 nt, Artificial Sequence
  Synthetic oligonucleotide
uccaaggcaugcuucggaaacuggaca

SEQ ID NO: 1918 - RNA, 27 nt, Artificial Sequence
  Synthetic oligonucleotide
aacgaagacgaugugaaaucguugucu

SEQ ID NO: 1919 - RNA, 27 nt, Artificial Sequence
  Synthetic oligonucleotide
gacgaugugaaaucguugucucgagug

SEQ ID NO: 1920 - RNA, 27 nt, Artificial Sequence
  Synthetic oligonucleotide
gggcaggauugugacucucauuucuuu

SEQ ID NO: 1921 - RNA, 27 nt, Artificial Sequence
  Synthetic oligonucleotide
uugugacucucauuucuuuuggugccu

SEQ ID NO: 1922 - RNA, 27 nt, Artificial Sequence
  Synthetic oligonucleotide
gccuuuguggcuaaacacuugaagacc

SEQ ID NO: 1923 - RNA, 27 nt, Artificial Sequence
  Synthetic oligonucleotide
uguggcuaaacacuugaagaccauaaa

SEQ ID NO: 1924 - RNA, 27 nt, Artificial Sequence
  Synthetic oligonucleotide
guggcuaaacacuugaagaccauaaac

SEQ ID NO: 1925 - RNA, 27 nt, Artificial Sequence
  Synthetic oligonucleotide
uggcuaaacacuugaagaccauaaacc

SEQ ID NO: 1926 - RNA, 27 nt, Artificial Sequence
  Synthetic oligonucleotide
ggcuaaacacuugaagaccauaaacca

SEQ ID NO: 1927 - RNA, 27 nt, Artificial Sequence
  Synthetic oligonucleotide
acacuugaagaccauaaaccaagaaag

SEQ ID NO: 1928 - RNA, 27 nt, Artificial Sequence
  Synthetic oligonucleotide
cacuugaagaccauaaaccaagaaagc

SEQ ID NO: 1929 - RNA, 27 nt, Artificial Sequence
  Synthetic oligonucleotide
gaagaccauaaaccaagaaagcugcau

SEQ ID NO: 1930 - RNA, 27 nt, Artificial Sequence
  Synthetic oligonucleotide
ugcaucgaaccauuagcagaaaguauc

SEQ ID NO: 1931 - RNA, 27 nt, Artificial Sequence
  Synthetic oligonucleotide
gcaucgaaccauuagcagaaaguauca

SEQ ID NO: 1932 - RNA, 27 nt, Artificial Sequence
  Synthetic oligonucleotide
gaaccauuagcagaaaguaucacagac

SEQ ID NO: 1933 - RNA, 27 nt, Artificial Sequence
  Synthetic oligonucleotide
acgggacuggcuaguuaaacaaagagg

SEQ ID NO: 1934 - RNA, 27 nt, Artificial Sequence
  Synthetic oligonucleotide
cgggacuggcuaguuaaacaaagaggc

SEQ ID NO: 1935 - RNA, 27 nt, Artificial Sequence
  Synthetic oligonucleotide
ggcuaguuaaacaaagaggcugggaug

SEQ ID NO: 1936 - RNA, 27 nt, Artificial Sequence
  Synthetic oligonucleotide
uuaaacaaagaggcugggauggguuug

SEQ ID NO: 1937 - RNA, 27 nt, Artificial Sequence
  Synthetic oligonucleotide
uaaacaaagaggcugggauggguuugu

SEQ ID NO: 1938 - RNA, 27 nt, Artificial Sequence
  Synthetic oligonucleotide
aaacaaagaggcugggauggguuugug

SEQ ID NO: 1939 - RNA, 27 nt, Artificial Sequence
  Synthetic oligonucleotide
aacaaagaggcugggauggguuugugg

SEQ ID NO: 1940 - RNA, 27 nt, Artificial Sequence
  Synthetic oligonucleotide
acaaagaggcugggauggguuugugga

SEQ ID NO: 1941 - RNA, 27 nt, Artificial Sequence
  Synthetic oligonucleotide
caaagaggcugggauggguuuguggag

SEQ ID NO: 1942 - RNA, 27 nt, Artificial Sequence
  Synthetic oligonucleotide
aaagaggcugggauggguuuguggagu

SEQ ID NO: 1943 - RNA, 27 nt, Artificial Sequence
  Synthetic oligonucleotide
aagaggcugggauggguuuguggaguu

SEQ ID NO: 1944 - RNA, 27 nt, Artificial Sequence
  Synthetic oligonucleotide
agaggcugggauggguuuguggaguuc

SEQ ID NO: 1945 - RNA, 27 nt, Artificial Sequence
  Synthetic oligonucleotide
gaggcugggauggguuuguggaguucu

SEQ ID NO: 1946 - RNA, 27 nt, Artificial Sequence
  Synthetic oligonucleotide
aggcugggauggguuuguggaguucuu

SEQ ID NO: 1947 - RNA, 27 nt, Artificial Sequence
  Synthetic oligonucleotide
ggcugggauggguuuguggaguucuuc

SEQ ID NO: 1948 - RNA, 27 nt, Artificial Sequence
  Synthetic oligonucleotide
gcugggauggguuuguggaguucuucc

SEQ ID NO: 1949 - RNA, 27 nt, Artificial Sequence
  Synthetic oligonucleotide
cugggauggguuuguggaguucuucca

SEQ ID NO: 1950 - RNA, 27 nt, Artificial Sequence
  Synthetic oligonucleotide
ugggauggguuuguggaguucuuccau

SEQ ID NO: 1951 - RNA, 27 nt, Artificial Sequence
  Synthetic oligonucleotide
gggauggguuuguggaguucuuccaug

SEQ ID NO: 1952 - RNA, 27 nt, Artificial Sequence
  Synthetic oligonucleotide
ggauggguuuguggaguucuuccaugu

SEQ ID NO: 1953 - RNA, 27 nt, Artificial Sequence
  Synthetic oligonucleotide
gauggguuuguggaguucuuccaugua

SEQ ID NO: 1954 - RNA, 27 nt, Artificial Sequence
  Synthetic oligonucleotide
auggguuuguggaguucuuccauguag

SEQ ID NO: 1955 - RNA, 27 nt, Artificial Sequence
  Synthetic oligonucleotide
uggguuuguggaguucuuccauguaga

SEQ ID NO: 1956 - RNA, 27 nt, Artificial Sequence
  Synthetic oligonucleotide
ggaguucuuccauguagaggaccuaga

SEQ ID NO: 1957 - RNA, 27 nt, Artificial Sequence
  Synthetic oligonucleotide
uuccauguagaggaccuagaagguggc

SEQ ID NO: 1958 - RNA, 27 nt, Artificial Sequence
  Synthetic oligonucleotide
gaggaccuagaagguggcaucaggaau

SEQ ID NO: 1959 - RNA, 27 nt, Artificial Sequence
  Synthetic oligonucleotide
cagguguugcuggaguaggagcugguu

SEQ ID NO: 1960 - RNA, 27 nt, Artificial Sequence
  Synthetic oligonucleotide
agcugguuuggcauaucuaauaagaua

SEQ ID NO: 1961 - RNA, 27 nt, Artificial Sequence
  Synthetic oligonucleotide
uuuggcauaucuaauaagauagccuua

SEQ ID NO: 1962 - RNA, 27 nt, Artificial Sequence
  Synthetic oligonucleotide
uuggcauaucuaauaagauagccuuac

SEQ ID NO: 1963 - RNA, 27 nt, Artificial Sequence
  Synthetic oligonucleotide
uggcauaucuaauaagauagccuuacu

SEQ ID NO: 1964 - RNA, 27 nt, Artificial Sequence
  Synthetic oligonucleotide
ggcauaucuaauaagauagccuuacug

SEQ ID NO: 1965 - RNA, 27 nt, Artificial Sequence
  Synthetic oligonucleotide
gcauaucuaauaagauagccuuacugu

SEQ ID NO: 1966 - RNA, 27 nt, Artificial Sequence
  Synthetic oligonucleotide
cauaucuaauaagauagccuuacugua

SEQ ID NO: 1967 - RNA, 27 nt, Artificial Sequence
  Synthetic oligonucleotide
uagccuuacuguaagugcaauaguuga

SEQ ID NO: 1968 - RNA, 27 nt, Artificial Sequence
  Synthetic oligonucleotide
uuggacuccaagcuguaacuuccuaga

SEQ ID NO: 1969 - RNA, 27 nt, Artificial Sequence
  Synthetic oligonucleotide
acuuccuagaguugcacccuagcaacc

SEQ ID NO: 1970 - RNA, 27 nt, Artificial Sequence
  Synthetic oligonucleotide
aagcaaguggcaagaggauuauggcua

SEQ ID NO: 1971 - RNA, 27 nt, Artificial Sequence
  Synthetic oligonucleotide
aguggcaagaggauuauggcuaacaag

SEQ ID NO: 1972 - RNA, 27 nt, Artificial Sequence
  Synthetic oligonucleotide
guggcaagaggauuauggcuaacaaga

SEQ ID NO: 1973 - RNA, 27 nt, Artificial Sequence
  Synthetic oligonucleotide
aagaggauuauggcuaacaagaauaaa

SEQ ID NO: 1974 - RNA, 27 nt, Artificial Sequence
  Synthetic oligonucleotide
uauggcuaacaagaauaaauacauggg

SEQ ID NO: 1975 - RNA, 27 nt, Artificial Sequence
  Synthetic oligonucleotide
auggcuaacaagaauaaauacauggga

SEQ ID NO: 1976 - RNA, 27 nt, Artificial Sequence
  Synthetic oligonucleotide
uggcuaacaagaauaaauacaugggaa

SEQ ID NO: 1977 - RNA, 27 nt, Artificial Sequence
  Synthetic oligonucleotide
ggcuaacaagaauaaauacaugggaag

SEQ ID NO: 1978 - RNA, 27 nt, Artificial Sequence
  Synthetic oligonucleotide
gcuaacaagaauaaauacaugggaaga

SEQ ID NO: 1979 - RNA, 27 nt, Artificial Sequence
  Synthetic oligonucleotide
cuaacaagaauaaauacaugggaagag

SEQ ID NO: 1980 - RNA, 27 nt, Artificial Sequence
  Synthetic oligonucleotide
uaacaagaauaaauacaugggaagagu

SEQ ID NO: 1981 - RNA, 27 nt, Artificial Sequence
  Synthetic oligonucleotide
aacaagaauaaauacaugggaagagug

SEQ ID NO: 1982 - RNA, 27 nt, Artificial Sequence
  Synthetic oligonucleotide
acaagaauaaauacaugggaagagugc

SEQ ID NO: 1983 - RNA, 27 nt, Artificial Sequence
  Synthetic oligonucleotide
caagaauaaauacaugggaagagugcu

SEQ ID NO: 1984 - RNA, 27 nt, Artificial Sequence
  Synthetic oligonucleotide
cccauugauugaagagucacugucuga

SEQ ID NO: 1985 - RNA, 27 nt, Artificial Sequence
  Synthetic oligonucleotide
cacugucugaaagaagcaaaguucagu

SEQ ID NO: 1986 - RNA, 27 nt, Artificial Sequence
  Synthetic oligonucleotide
aaacaaacuuuguuugggaagcuaugg

SEQ ID NO: 1987 - RNA, 27 nt, Artificial Sequence
  Synthetic oligonucleotide
ggaggacuuuuagauuuagugaagaug

SEQ ID NO: 1988 - RNA, 27 nt, Artificial Sequence
  Synthetic oligonucleotide
gaagaugguaggguggaaagacuuaau

SEQ ID NO: 1989 - RNA, 27 nt, Artificial Sequence
  Synthetic oligonucleotide
uccuuguugagaacaggaaaguggcca

SEQ ID NO: 1990 - RNA, 27 nt, Artificial Sequence
  Synthetic oligonucleotide
uagccaggcaagucauagaauugauua

SEQ ID NO: 1991 - RNA, 27 nt, Artificial Sequence
  Synthetic oligonucleotide
ccaggcaagucauagaauugauuaccc

SEQ ID NO: 1992 - RNA, 27 nt, Artificial Sequence
  Synthetic oligonucleotide
caggcaagucauagaauugauuacccg

SEQ ID NO: 1993 - RNA, 27 nt, Artificial Sequence
  Synthetic oligonucleotide
uacccgccgaauucauuaauuuacugu

SEQ ID NO: 1994 - RNA, 27 nt, Artificial Sequence
  Synthetic oligonucleotide
gccgaauucauuaauuuacuguagugu

SEQ ID NO: 1995 - RNA, 27 nt, Artificial Sequence
  Synthetic oligonucleotide
uaguguuaagagaagcacuaagaaugc

SEQ ID NO: 1996 - RNA, 27 nt, Artificial Sequence
  Synthetic oligonucleotide
gaagcacuaagaaugccagugaccugu

SEQ ID NO: 1997 - RNA, 27 nt, Artificial Sequence
  Synthetic oligonucleotide
acaaguaauagaacuaugacuguaagc

SEQ ID NO: 1998 - RNA, 27 nt, Artificial Sequence
  Synthetic oligonucleotide
aaguaauagaacuaugacuguaagccu

SEQ ID NO: 1999 - RNA, 27 nt, Artificial Sequence
  Synthetic oligonucleotide
gccucaguacuguacaagggaagcuuu

SEQ ID NO: 2000 - RNA, 27 nt, Artificial Sequence
  Synthetic oligonucleotide
ucccaguauacuucuuagaaaguccaa

SEQ ID NO: 2001 - RNA, 27 nt, Artificial Sequence
  Synthetic oligonucleotide
uaccuguuauacuuuggcuugguuucc

SEQ ID NO: 2002 - RNA, 27 nt, Artificial Sequence
  Synthetic oligonucleotide
agccuaguuuaucaccaauaauacuug

SEQ ID NO: 2003 - RNA, 27 nt, Artificial Sequence
  Synthetic oligonucleotide
aucaccaauaauacuugacggaaggcu

SEQ ID NO: 2004 - RNA, 27 nt, Artificial Sequence
  Synthetic oligonucleotide
ucaccaauaauacuugacggaaggcuc

SEQ ID NO: 2005 - RNA, 27 nt, Artificial Sequence
  Synthetic oligonucleotide
caccaauaauacuugacggaaggcuca

SEQ ID NO: 2006 - RNA, 27 nt, Artificial Sequence
  Synthetic oligonucleotide
aaggcucaguaauuaguuaugaauaug

SEQ ID NO: 2007 - RNA, 27 nt, Artificial Sequence
  Synthetic oligonucleotide
cucaguaauuaguuaugaauauggaua

SEQ ID NO: 2008 - RNA, 27 nt, Artificial Sequence
  Synthetic oligonucleotide
auucuuaagacagcuuguaaauguauu

SEQ ID NO: 2009 - RNA, 27 nt, Artificial Sequence
  Synthetic oligonucleotide
uguaaaaauuguauauauuuuuacaga

SEQ ID NO: 2010 - RNA, 27 nt, Artificial Sequence
  Synthetic oligonucleotide
uuuacagaaagucuauuucuuugaaac

SEQ ID NO: 2011 - RNA, 27 nt, Artificial Sequence
  Synthetic oligonucleotide
uuacagaaagucuauuucuuugaaacg

SEQ ID NO: 2012 - RNA, 27 nt, Artificial Sequence
  Synthetic oligonucleotide
uacagaaagucuauuucuuugaaacga

SEQ ID NO: 2013 - RNA, 27 nt, Artificial Sequence
  Synthetic oligonucleotide
acagaaagucuauuucuuugaaacgaa

SEQ ID NO: 2014 - RNA, 27 nt, Artificial Sequence
  Synthetic oligonucleotide
cagaaagucuauuucuuugaaacgaag

SEQ ID NO: 2015 - RNA, 27 nt, Artificial Sequence
  Synthetic oligonucleotide
aacgaaggaaguaucgaauuuacauua

SEQ ID NO: 2016 - RNA, 27 nt, Artificial Sequence
  Synthetic oligonucleotide
aucgaauuuacauuaguuuuuuucaua

SEQ ID NO: 2017 - RNA, 27 nt, Artificial Sequence
  Synthetic oligonucleotide
gaacuuugcaacuuccguaauuaggaa

SEQ ID NO: 2018 - RNA, 27 nt, Artificial Sequence
  Synthetic oligonucleotide
agaguguauacagaacgaauugaugug

SEQ ID NO: 2019 - RNA, 27 nt, Artificial Sequence
  Synthetic oligonucleotide
guggaacaaaucugauaacuaugcagg

SEQ ID NO: 2020 - RNA, 27 nt, Artificial Sequence
  Synthetic oligonucleotide
aaauuuucuuaucugauuuugguaagu

SEQ ID NO: 2021 - RNA, 27 nt, Artificial Sequence
  Synthetic oligonucleotide
uagguuuuucuuugaaaaccugggauu

SEQ ID NO: 2022 - RNA, 27 nt, Artificial Sequence
  Synthetic oligonucleotide
cugggauugagagguugaugaauggaa

SEQ ID NO: 2023 - RNA, 27 nt, Artificial Sequence
  Synthetic oligonucleotide
ugagagguugaugaauggaaauucuuu

SEQ ID NO: 2024 - RNA, 27 nt, Artificial Sequence
  Synthetic oligonucleotide
agguugaugaauggaaauucuuucacu

SEQ ID NO: 2025 - RNA, 27 nt, Artificial Sequence
  Synthetic oligonucleotide
uauaugcaaguuuucaauaauuagguc

SEQ ID NO: 2026 - RNA, 27 nt, Artificial Sequence
  Synthetic oligonucleotide
aagguuacugaugacuuacaaauaaug

SEQ ID NO: 2027 - RNA, 27 nt, Artificial Sequence
  Synthetic oligonucleotide
auugggcaauacucauuugaguuccuu

SEQ ID NO: 2028 - RNA, 27 nt, Artificial Sequence
  Synthetic oligonucleotide
uuccauuugaccuaauuuaacugguga

SEQ ID NO: 2029 - RNA, 27 nt, Artificial Sequence
  Synthetic oligonucleotide
uuaaagcuuuuacuaaaagauuuucag

SEQ ID NO: 2030 - RNA, 27 nt, Artificial Sequence
  Synthetic oligonucleotide
cagguggauggagagacauuugauccc

SEQ ID NO: 2031 - RNA, 27 nt, Artificial Sequence
  Synthetic oligonucleotide
ugcuuaauaaauuauaaaaugauggcu

SEQ ID NO: 2032 - RNA, 27 nt, Artificial Sequence
  Synthetic oligonucleotide
uaaccauggugcuauuauuaggcuugc

SEQ ID NO: 2033 - RNA, 27 nt, Artificial Sequence
  Synthetic oligonucleotide
uaagccuaguaugucaauaaagcaaau

SEQ ID NO: 2034 - RNA, 27 nt, Artificial Sequence
  Synthetic oligonucleotide
uacuguuuuguuucuauuaaugauucc

SEQ ID NO: 2035 - RNA, 27 nt, Artificial Sequence
  Synthetic oligonucleotide
uucuauuaaugauucccaaaccuuguu

SEQ ID NO: 2036 - RNA, 27 nt, Artificial Sequence
  Synthetic oligonucleotide
cuuguugcaaguuuuugcauuggcauc

SEQ ID NO: 2037 - RNA, 27 nt, Artificial Sequence
  Synthetic oligonucleotide
uuggauuucagucuugauguuuguucu

SEQ ID NO: 2038 - RNA, 27 nt, Artificial Sequence
  Synthetic oligonucleotide
cuuccuugaaauugcugauuguucugc

SEQ ID NO: 2039 - RNA, 27 nt, Artificial Sequence
  Synthetic oligonucleotide
gcucccucuacagauauuuauaucaau

SEQ ID NO: 2040 - RNA, 27 nt, Artificial Sequence
  Synthetic oligonucleotide
ccaccaagaguccacagaccuuucauc

SEQ ID NO: 2041 - RNA, 27 nt, Artificial Sequence
  Synthetic oligonucleotide
caccaagaguccacagaccuuucaucu

SEQ ID NO: 2042 - RNA, 27 nt, Artificial Sequence
  Synthetic oligonucleotide
gaguccacagaccuuucaucuuucacg

SEQ ID NO: 2043 - RNA, 27 nt, Artificial Sequence
  Synthetic oligonucleotide
aguccacagaccuuucaucuuucacga

SEQ ID NO: 2044 - RNA, 27 nt, Artificial Sequence
  Synthetic oligonucleotide
guccacagaccuuucaucuuucacgaa

SEQ ID NO: 2045 - RNA, 27 nt, Artificial Sequence
  Synthetic oligonucleotide
uccacagaccuuucaucuuucacgaac

SEQ ID NO: 2046 - RNA, 27 nt, Artificial Sequence
  Synthetic oligonucleotide
acagaccuuucaucuuucacgaacuug

SEQ ID NO: 2047 - RNA, 27 nt, Artificial Sequence
  Synthetic oligonucleotide
gaccuuucaucuuucacgaacuugauc

SEQ ID NO: 2048 - RNA, 27 nt, Artificial Sequence
  Synthetic oligonucleotide
cugugacacuaacagucauugagaggu

SEQ ID NO: 2049 - RNA, 27 nt, Artificial Sequence
  Synthetic oligonucleotide
cacuaacagucauugagaggugggagg

SEQ ID NO: 2050 - RNA, 27 nt, Artificial Sequence
  Synthetic oligonucleotide
uaggaguaugcucacuuaaauuuacag

SEQ ID NO: 2051 - RNA, 27 nt, Artificial Sequence
  Synthetic oligonucleotide
gcucacuuaaauuuacagaaagaggug

SEQ ID NO: 2052 - RNA, 27 nt, Artificial Sequence
  Synthetic oligonucleotide
cacuuaaauuuacagaaagaggugagc

SEQ ID NO: 2053 - RNA, 27 nt, Artificial Sequence
  Synthetic oligonucleotide
aaacugaagaaagugucuauauuggaa

SEQ ID NO: 2054 - RNA, 27 nt, Artificial Sequence
  Synthetic oligonucleotide
uuggaacuagggucauuugaaagcuuc

SEQ ID NO: 2055 - RNA, 27 nt, Artificial Sequence
  Synthetic oligonucleotide
aacuagggucauuugaaagcuucaguc

SEQ ID NO: 2056 - RNA, 27 nt, Artificial Sequence
  Synthetic oligonucleotide
acuagggucauuugaaagcuucagucu

SEQ ID NO: 2057 - RNA, 27 nt, Artificial Sequence
  Synthetic oligonucleotide
cuagggucauuugaaagcuucagucuc

SEQ ID NO: 2058 - RNA, 27 nt, Artificial Sequence
  Synthetic oligonucleotide
uagggucauuugaaagcuucagucucg

SEQ ID NO: 2059 - RNA, 27 nt, Artificial Sequence
  Synthetic oligonucleotide
agggucauuugaaagcuucagucucgg

SEQ ID NO: 2060 - RNA, 27 nt, Artificial Sequence
  Synthetic oligonucleotide
ucagucucggaacaugaccuuuagucu

SEQ ID NO: 2061 - RNA, 27 nt, Artificial Sequence
  Synthetic oligonucleotide
cggaacaugaccuuuagucuguggacu

SEQ ID NO: 2062 - RNA, 27 nt, Artificial Sequence
  Synthetic oligonucleotide
gaacaugaccuuuagucuguggacucc

SEQ ID NO: 2063 - RNA, 27 nt, Artificial Sequence
  Synthetic oligonucleotide
uccauuuaaaaauagguaugaauaaga

SEQ ID NO: 2064 - RNA, 27 nt, Artificial Sequence
  Synthetic oligonucleotide
uagguaugaauaagaugacuaagaaug

SEQ ID NO: 2065 - RNA, 27 nt, Artificial Sequence
  Synthetic oligonucleotide
cugcccaucucagagccauaaggucau

SEQ ID NO: 2066 - RNA, 27 nt, Artificial Sequence
  Synthetic oligonucleotide
uuaccuauguauuuaucguucuugauc

SEQ ID NO: 2067 - RNA, 27 nt, Artificial Sequence
  Synthetic oligonucleotide
aagccgcuuauuuauaucauguaucuc

SEQ ID NO: 2068 - RNA, 27 nt, Artificial Sequence
  Synthetic oligonucleotide
auguaguuuuuaauuaaucuuaagauc

SEQ ID NO: 2069 - RNA, 27 nt, Artificial Sequence
  Synthetic oligonucleotide
agccugucugccaaauccaguggaaac

SEQ ID NO: 2070 - RNA, 27 nt, Artificial Sequence
  Synthetic oligonucleotide
ucugccaaauccaguggaaacaagugc

SEQ ID NO: 2071 - RNA, 27 nt, Artificial Sequence
  Synthetic oligonucleotide
ccaguggaaacaagugcauagauguga

SEQ ID NO: 2072 - RNA, 27 nt, Artificial Sequence
  Synthetic oligonucleotide
guggaaacaagugcauagaugugaauu

SEQ ID NO: 2073 - RNA, 27 nt, Artificial Sequence
  Synthetic oligonucleotide
ccacuucccaauucauuagguaugacu

SEQ ID NO: 2074 - RNA, 27 nt, Artificial Sequence
  Synthetic oligonucleotide
uagguaugacuguggaaauacagacaa

SEQ ID NO: 2075 - RNA, 27 nt, Artificial Sequence
  Synthetic oligonucleotide
augacuguggaaauacagacaaggauc

SEQ ID NO: 2076 - RNA, 27 nt, Artificial Sequence
  Synthetic oligonucleotide
ugacuguggaaauacagacaaggaucu

SEQ ID NO: 2077 - RNA, 27 nt, Artificial Sequence
  Synthetic oligonucleotide
acuguggaaauacagacaaggaucuua

SEQ ID NO: 2078 - RNA, 27 nt, Artificial Sequence
  Synthetic oligonucleotide
cuguggaaauacagacaaggaucuuag

SEQ ID NO: 2079 - RNA, 27 nt, Artificial Sequence
  Synthetic oligonucleotide
uguggaaauacagacaaggaucuuagu

SEQ ID NO: 2080 - RNA, 27 nt, Artificial Sequence
  Synthetic oligonucleotide
guggaaauacagacaaggaucuuaguu

SEQ ID NO: 2081 - RNA, 27 nt, Artificial Sequence
  Synthetic oligonucleotide
uggaaauacagacaaggaucuuaguug

SEQ ID NO: 2082 - RNA, 27 nt, Artificial Sequence
  Synthetic oligonucleotide
gaggaggaggcagguggucuaagugcu

SEQ ID NO: 2083 - RNA, 27 nt, Artificial Sequence
  Synthetic oligonucleotide
uggcuacguaguucgggcaaauccucc

SEQ ID NO: 2084 - RNA, 27 nt, Artificial Sequence
  Synthetic oligonucleotide
ggaggauuugcuuagaaggauggcgcu

SEQ ID NO: 2085 - RNA, 27 nt, Artificial Sequence
  Synthetic oligonucleotide
gaggauuugcuuagaaggauggcgcuc

SEQ ID NO: 2086 - RNA, 27 nt, Artificial Sequence
  Synthetic oligonucleotide
guccucuaguguuucauguacauucug

SEQ ID NO: 2087 - RNA, 27 nt, Artificial Sequence
  Synthetic oligonucleotide
gaacaccuugguucugguuaaacagcu

SEQ ID NO: 2088 - RNA, 27 nt, Artificial Sequence
  Synthetic oligonucleotide
auagcugugccaggaaggguuaggacc

SEQ ID NO: 2089 - RNA, 27 nt, Artificial Sequence
  Synthetic oligonucleotide
ccaggaaggguuaggaccaacuacaaa

SEQ ID NO: 2090 - RNA, 27 nt, Artificial Sequence
  Synthetic oligonucleotide
aggguuaggaccaacuacaaauuaaug

SEQ ID NO: 2091 - RNA, 27 nt, Artificial Sequence
  Synthetic oligonucleotide
agggaacggccuuccucacuccugacu

SEQ ID NO: 2092 - RNA, 27 nt, Artificial Sequence
  Synthetic oligonucleotide
cugcggagaaacgcggucaucggcuug

SEQ ID NO: 2093 - RNA, 27 nt, Artificial Sequence
  Synthetic oligonucleotide
ccggaggaggaacuggacggcugcgag

SEQ ID NO: 2094 - RNA, 27 nt, Artificial Sequence
  Synthetic oligonucleotide
cgaggaggaagaggacgaccuauaccg

SEQ ID NO: 2095 - RNA, 27 nt, Artificial Sequence
  Synthetic oligonucleotide
gaggaggaagaggacgaccuauaccgc

SEQ ID NO: 2096 - RNA, 27 nt, Artificial Sequence
  Synthetic oligonucleotide
aggaggaagaggacgaccuauaccgcc

SEQ ID NO: 2097 - RNA, 27 nt, Artificial Sequence
  Synthetic oligonucleotide
gaggaagaggacgaccuauaccgccag

SEQ ID NO: 2098 - RNA, 27 nt, Artificial Sequence
  Synthetic oligonucleotide
caggauugugacucuuauuucuuucgg

SEQ ID NO: 2099 - RNA, 27 nt, Artificial Sequence
  Synthetic oligonucleotide
uguggccaaacacuuaaagagcguaaa

SEQ ID NO: 2100 - RNA, 27 nt, Artificial Sequence
  Synthetic oligonucleotide
guggccaaacacuuaaagagcguaaac

SEQ ID NO: 2101 - RNA, 27 nt, Artificial Sequence
  Synthetic oligonucleotide
uggccaaacacuuaaagagcguaaacc

SEQ ID NO: 2102 - RNA, 27 nt, Artificial Sequence
  Synthetic oligonucleotide
aaagagcguaaaccaagaaagcuucau

SEQ ID NO: 2103 - RNA, 27 nt, Artificial Sequence
  Synthetic oligonucleotide
cgaaccauuagcagaaacuaucacaga

SEQ ID NO: 2104 - RNA, 27 nt, Artificial Sequence
  Synthetic oligonucleotide
uuagcagaaacuaucacagauguucuu

SEQ ID NO: 2105 - RNA, 27 nt, Artificial Sequence
  Synthetic oligonucleotide
acgggacuggcuugucaaacaaagagg

SEQ ID NO: 2106 - RNA, 27 nt, Artificial Sequence
  Synthetic oligonucleotide
cgggacuggcuugucaaacaaagaggc

SEQ ID NO: 2107 - RNA, 27 nt, Artificial Sequence
  Synthetic oligonucleotide
uuguggaguucuuccacguacaggacc

SEQ ID NO: 2108 - RNA, 27 nt, Artificial Sequence
  Synthetic oligonucleotide
ggaguucuuccacguacaggaccuaga

SEQ ID NO: 2109 - RNA, 27 nt, Artificial Sequence
  Synthetic oligonucleotide
uuccacguacaggaccuagaaggcggc

SEQ ID NO: 2110 - RNA, 27 nt, Artificial Sequence
  Synthetic oligonucleotide
cuggucuggcauaucuaauaagauagc

SEQ ID NO: 2111 - RNA, 27 nt, Artificial Sequence
  Synthetic oligonucleotide
agccaccaaacuacaugcaucugugaa

SEQ ID NO: 2112 - RNA, 27 nt, Artificial Sequence
  Synthetic oligonucleotide
cauguguauuuaugaagguggacuuga

SEQ ID NO: 2113 - RNA, 27 nt, Artificial Sequence
  Synthetic oligonucleotide
uguguauuuaugaagguggacuugaag

SEQ ID NO: 2114 - RNA, 27 nt, Artificial Sequence
  Synthetic oligonucleotide
guauuuaugaagguggacuugaagcug

SEQ ID NO: 2115 - RNA, 27 nt, Artificial Sequence
  Synthetic oligonucleotide
guccaguucuacuguagcaacauagca

SEQ ID NO: 2116 - RNA, 27 nt, Artificial Sequence
  Synthetic oligonucleotide
cccuggaagagucacugucugaaugaa

SEQ ID NO: 2117 - RNA, 27 nt, Artificial Sequence
  Synthetic oligonucleotide
ccuggaagagucacugucugaaugaag

SEQ ID NO: 2118 - RNA, 27 nt, Artificial Sequence
  Synthetic oligonucleotide
cuggaagagucacugucugaaugaagc

SEQ ID NO: 2119 - RNA, 27 nt, Artificial Sequence
  Synthetic oligonucleotide
cacugucugaaugaagcaaaguucccu

SEQ ID NO: 2120 - RNA, 27 nt, Artificial Sequence
  Synthetic oligonucleotide
uucccucucagcaaacacugagaggcc

SEQ ID NO: 2121 - RNA, 27 nt, Artificial Sequence
  Synthetic oligonucleotide
ucccucucagcaaacacugagaggcca

SEQ ID NO: 2122 - RNA, 27 nt, Artificial Sequence
  Synthetic oligonucleotide
ucagcaaacacugagaggccauggaga

SEQ ID NO: 2123 - RNA, 27 nt, Artificial Sequence
  Synthetic oligonucleotide
aacacugagaggccauggagaaggacu

SEQ ID NO: 2124 - RNA, 27 nt, Artificial Sequence
  Synthetic oligonucleotide
gaggccauggagaaggacuucuagaau

SEQ ID NO: 2125 - RNA, 27 nt, Artificial Sequence
  Synthetic oligonucleotide
aggccauggagaaggacuucuagaaug

SEQ ID NO: 2126 - RNA, 27 nt, Artificial Sequence
  Synthetic oligonucleotide
uggagaaggacuucuagaaugaaugaa

SEQ ID NO: 2127 - RNA, 27 nt, Artificial Sequence
  Synthetic oligonucleotide
gaaggacuucuagaaugaaugaaaggg

SEQ ID NO: 2128 - RNA, 27 nt, Artificial Sequence
  Synthetic oligonucleotide
guggauggaaagguuugauuuccuauc

SEQ ID NO: 2129 - RNA, 27 nt, Artificial Sequence
  Synthetic oligonucleotide
ccagucaucaggcuagucacaaagcuc

SEQ ID NO: 2130 - RNA, 27 nt, Artificial Sequence
  Synthetic oligonucleotide
cagucaucaggcuagucacaaagcuca

SEQ ID NO: 2131 - RNA, 27 nt, Artificial Sequence
  Synthetic oligonucleotide
aggcuagucacaaagcucaauaaauau

SEQ ID NO: 2132 - RNA, 27 nt, Artificial Sequence
  Synthetic oligonucleotide
aagcccuaauuaacaacguuggugacu

SEQ ID NO: 2133 - RNA, 27 nt, Artificial Sequence
  Synthetic oligonucleotide
aaccuacaagucaccaaacgaugacua

SEQ ID NO: 2134 - RNA, 27 nt, Artificial Sequence
  Synthetic oligonucleotide
accuacaagucaccaaacgaugacuag

SEQ ID NO: 2135 - RNA, 27 nt, Artificial Sequence
  Synthetic oligonucleotide
agucaccaaacgaugacuagaagcugc

SEQ ID NO: 2136 - RNA, 27 nt, Artificial Sequence
  Synthetic oligonucleotide
gucaccaaacgaugacuagaagcugca

SEQ ID NO: 2137 - RNA, 27 nt, Artificial Sequence
  Synthetic oligonucleotide
ucaccaaacgaugacuagaagcugcag

SEQ ID NO: 2138 - RNA, 27 nt, Artificial Sequence
  Synthetic oligonucleotide
caccaaacgaugacuagaagcugcagu

SEQ ID NO: 2139 - RNA, 27 nt, Artificial Sequence
  Synthetic oligonucleotide
caggaaugugaagggaggccucugagc

SEQ ID NO: 2140 - RNA, 27 nt, Artificial Sequence
  Synthetic oligonucleotide
ugugcuugacaaagucccaagugcuca

SEQ ID NO: 2141 - RNA, 27 nt, Artificial Sequence
  Synthetic oligonucleotide
gugcuugacaaagucccaagugcucag

SEQ ID NO: 2142 - RNA, 27 nt, Artificial Sequence
  Synthetic oligonucleotide
uugacaaagucccaagugcucaggacu

SEQ ID NO: 2143 - RNA, 27 nt, Artificial Sequence
  Synthetic oligonucleotide
agcccugucuacuuuggcuugguuugg

SEQ ID NO: 2144 - RNA, 27 nt, Artificial Sequence
  Synthetic oligonucleotide
uucuuaaguuuauuagccuagugaugg

SEQ ID NO: 2145 - RNA, 27 nt, Artificial Sequence
  Synthetic oligonucleotide
aaaguacuugacuuaagguucacuaau

SEQ ID NO: 2146 - RNA, 27 nt, Artificial Sequence
  Synthetic oligonucleotide
gaacauaagagggaagucuuggauuua

SEQ ID NO: 2147 - RNA, 27 nt, Artificial Sequence
  Synthetic oligonucleotide
cagcuucucuaguuagaaauguauuuc

SEQ ID NO: 2148 - RNA, 27 nt, Artificial Sequence
  Synthetic oligonucleotide
ugucauccguucuaguguauaugcaga

SEQ ID NO: 2149 - RNA, 27 nt, Artificial Sequence
  Synthetic oligonucleotide
uguguguggacugguuauagauuuaua

SEQ ID NO: 2150 - RNA, 27 nt, Artificial Sequence
  Synthetic oligonucleotide
uaacuaugcaggguuaauuauccaauc

SEQ ID NO: 2151 - RNA, 27 nt, Artificial Sequence
  Synthetic oligonucleotide
aucacagguagauagauguaagacauu

SEQ ID NO: 2152 - RNA, 27 nt, Artificial Sequence
  Synthetic oligonucleotide
agguagauagauguaagacauuugauc

SEQ ID NO: 2153 - RNA, 27 nt, Artificial Sequence
  Synthetic oligonucleotide
guaaaugguaaagcaggcuagagucuu

SEQ ID NO: 2154 - RNA, 27 nt, Artificial Sequence
  Synthetic oligonucleotide
auggugcuauucacuggguuuacuugu

SEQ ID NO: 2155 - RNA, 27 nt, Artificial Sequence
  Synthetic oligonucleotide
uuucuugucuacuaaggauugccaagc

SEQ ID NO: 2156 - RNA, 27 nt, Artificial Sequence
  Synthetic oligonucleotide
uggucucuagguguagccuuuacuucc

SEQ ID NO: 2157 - RNA, 27 nt, Artificial Sequence
  Synthetic oligonucleotide
cccuauagagucgucuacacuuccucc

SEQ ID NO: 2158 - RNA, 27 nt, Artificial Sequence
  Synthetic oligonucleotide
gucgucuacacuuccucccugugcucu

SEQ ID NO: 2159 - RNA, 27 nt, Artificial Sequence
  Synthetic oligonucleotide
uaguuaucugcauuagaacucucaccc

SEQ ID NO: 2160 - RNA, 27 nt, Artificial Sequence
  Synthetic oligonucleotide
auccuaaucagagucagcacagcuuuc

SEQ ID NO: 2161 - RNA, 27 nt, Artificial Sequence
  Synthetic oligonucleotide
acagcuuuccugucagaggauaggaac

SEQ ID NO: 2162 - RNA, 27 nt, Artificial Sequence
  Synthetic oligonucleotide
uuccugucagaggauaggaacacuugc

SEQ ID NO: 2163 - RNA, 27 nt, Artificial Sequence
  Synthetic oligonucleotide
cugucagaggauaggaacacuugcucu

SEQ ID NO: 2164 - RNA, 27 nt, Artificial Sequence
  Synthetic oligonucleotide
ugucagaggauaggaacacuugcucuu

SEQ ID NO: 2165 - RNA, 27 nt, Artificial Sequence
  Synthetic oligonucleotide
gaccgacagugaccagggauuggcauu

SEQ ID NO: 2166 - RNA, 27 nt, Artificial Sequence
  Synthetic oligonucleotide
caugcuuuccauuguuacuuugucuau

SEQ ID NO: 2167 - RNA, 27 nt, Artificial Sequence
  Synthetic oligonucleotide
aagguuggaaauuauacguuuauacuu

SEQ ID NO: 2168 - RNA, 27 nt, Artificial Sequence
  Synthetic oligonucleotide
uuauuaguuugcuccaaguaugacugu

SEQ ID NO: 2169 - RNA, 27 nt, Artificial Sequence
  Synthetic oligonucleotide
uucacuuaaguuuagagaaacacuggg

SEQ ID NO: 2170 - RNA, 27 nt, Artificial Sequence
  Synthetic oligonucleotide
ccacugguaacugaagguauuuaagcu

SEQ ID NO: 2171 - RNA, 27 nt, Artificial Sequence
  Synthetic oligonucleotide
cagccucagaaugugaccuuuagucag

SEQ ID NO: 2172 - RNA, 27 nt, Artificial Sequence
  Synthetic oligonucleotide
aauaggcaggaaucaaaugacuaagaa

SEQ ID NO: 2173 - RNA, 27 nt, Artificial Sequence
  Synthetic oligonucleotide
auaggcaggaaucaaaugacuaagaau

SEQ ID NO: 2174 - RNA, 27 nt, Artificial Sequence
  Synthetic oligonucleotide
uaggcaggaaucaaaugacuaagaaug

SEQ ID NO: 2175 - RNA, 27 nt, Artificial Sequence
  Synthetic oligonucleotide
aggcaggaaucaaaugacuaagaaugu

SEQ ID NO: 2176 - RNA, 27 nt, Artificial Sequence
  Synthetic oligonucleotide
ggcaggaaucaaaugacuaagaaugua

SEQ ID NO: 2177 - RNA, 27 nt, Artificial Sequence
  Synthetic oligonucleotide
gcaggaaucaaaugacuaagaauguaa

SEQ ID NO: 2178 - RNA, 27 nt, Artificial Sequence
  Synthetic oligonucleotide
caggaaucaaaugacuaagaauguaau

SEQ ID NO: 2179 - RNA, 27 nt, Artificial Sequence
  Synthetic oligonucleotide
aggaaucaaaugacuaagaauguaaua

SEQ ID NO: 2180 - RNA, 27 nt, Artificial Sequence
  Synthetic oligonucleotide
augacuaagaauguaauagggaagaag

SEQ ID NO: 2181 - RNA, 27 nt, Artificial Sequence
  Synthetic oligonucleotide
cugccagcuugggagugauuuguaccu

SEQ ID NO: 2182 - RNA, 27 nt, Artificial Sequence
  Synthetic oligonucleotide
auccuugaucauaguuugcuuauuuau

SEQ ID NO: 2183 - RNA, 27 nt, Artificial Sequence
  Synthetic oligonucleotide
agagcacuuuauguaguugaauaaacc

SEQ ID NO: 2184 - RNA, 27 nt, Artificial Sequence
  Synthetic oligonucleotide
gagcacuuuauguaguugaauaaaccc

SEQ ID NO: 2185 - RNA, 27 nt, Artificial Sequence
  Synthetic oligonucleotide
uuuguuuacuaggagccugacuuccca

SEQ ID NO: 2186 - RNA, 27 nt, Artificial Sequence
  Synthetic oligonucleotide
agccugacuucccagcucacaaagggu

SEQ ID NO: 2187 - RNA, 27 nt, Artificial Sequence
  Synthetic oligonucleotide
gccugacuucccagcucacaaagggug

SEQ ID NO: 2188 - RNA, 27 nt, Artificial Sequence
  Synthetic oligonucleotide
ccugacuucccagcucacaaaggguga

SEQ ID NO: 2189 - RNA, 27 nt, Artificial Sequence
  Synthetic oligonucleotide
ucccagcucacaaagggugaaaugaaa

SEQ ID NO: 2190 - RNA, 27 nt, Artificial Sequence
  Synthetic oligonucleotide
agcucacaaagggugaaaugaaagcug

SEQ ID NO: 2191 - RNA, 27 nt, Artificial Sequence
  Synthetic oligonucleotide
gcugaaguacagacaggaucuuaguag

SEQ ID NO: 2192 - RNA, 27 nt, Artificial Sequence
  Synthetic oligonucleotide
gaaguacagacaggaucuuaguaggua

SEQ ID NO: 2193 - RNA, 27 nt, Artificial Sequence
  Synthetic oligonucleotide
gggccaugaagacuuggagagcgcagu

SEQ ID NO: 2194 - RNA, 27 nt, Artificial Sequence
  Synthetic oligonucleotide
cuuuggagggaagaagcauguggucug

SEQ ID NO: 2195 - RNA, 27 nt, Artificial Sequence
  Synthetic oligonucleotide
ugagugcugacuagaugaauaguugag

SEQ ID NO: 2196 - RNA, 27 nt, Artificial Sequence
  Synthetic oligonucleotide
gcugacuagaugaauaguugaggcaca

SEQ ID NO: 2197 - RNA, 27 nt, Artificial Sequence
  Synthetic oligonucleotide
ugaggcacauccuucagagaagaggga

SEQ ID NO: 2198 - RNA, 27 nt, Artificial Sequence
  Synthetic oligonucleotide
gaggcacauccuucagagaagagggag

SEQ ID NO: 2199 - RNA, 27 nt, Artificial Sequence
  Synthetic oligonucleotide
gggcugcuuggaaagauggcucucagc

SEQ ID NO: 2200 - RNA, 27 nt, Artificial Sequence
  Synthetic oligonucleotide
aaucuguuugucuuacacgucucucag

SEQ ID NO: 2201 - RNA, 27 nt, Artificial Sequence
  Synthetic oligonucleotide
caagcaucuuccauguacauucuaucu

SEQ ID NO: 2202 - RNA, 27 nt, Artificial Sequence
  Synthetic oligonucleotide
gagcaccuaacacuuuaacagcuguuc

SEQ ID NO: 2203 - RNA, 27 nt, Artificial Sequence
  Synthetic oligonucleotide
acagcuguucccgaaaggguuaggacc

SEQ ID NO: 2204 - RNA, 27 nt, Artificial Sequence
  Synthetic oligonucleotide
cccgaaaggguuaggaccaacugcaag

SEQ ID NO: 2205 - RNA, 27 nt, Artificial Sequence
  Synthetic oligonucleotide
gaccaacugcaaguuaauguggguugu

SEQ ID NO: 2206 - DNA, 25 bp, Artificial Sequence
  Synthetic oligonucleotide
gaagacgaugugaaaucguuguctc

SEQ ID NO: 2207 - DNA, 25 bp, Artificial Sequence
  Synthetic oligonucleotide
aggauugugacucucauuucuuutg

SEQ ID NO: 2208 - DNA, 25 bp, Artificial Sequence
  Synthetic oligonucleotide
gauugugacucucauuucuuuuggt

SEQ ID NO: 2209 - DNA, 25 bp, Artificial Sequence
  Synthetic oligonucleotide
ggugccuuuguggcuaaacacuuga

SEQ ID NO: 2210 - DNA, 25 bp, Artificial Sequence
  Synthetic oligonucleotide
gccuuuguggcuaaacacuugaaga

SEQ ID NO: 2211 - DNA, 25 bp, Artificial Sequence
  Synthetic oligonucleotide
gguuuguggaguucuuccauguaga

SEQ ID NO: 2212 - DNA, 25 bp, Artificial Sequence
  Synthetic oligonucleotide
ccuagcaaccuagccagaaaagcaa

SEQ ID NO: 2213 - DNA, 25 bp, Artificial Sequence
  Synthetic oligonucleotide
gcaaccuagccagaaaagcaagugg

SEQ ID NO: 2214 - DNA, 25 bp, Artificial Sequence
  Synthetic oligonucleotide
aaaagcaaguggcaagaggauuatg

SEQ ID NO: 2215 - DNA, 25 bp, Artificial Sequence
  Synthetic oligonucleotide
aagaggauuauggcuaacaagaata

SEQ ID NO: 2216 - DNA, 25 bp, Artificial Sequence
  Synthetic oligonucleotide
ggauuauggcuaacaagaauaaata

SEQ ID NO: 2217 - DNA, 25 bp, Artificial Sequence
  Synthetic oligonucleotide
auuauggcuaacaagaauaaauaca

SEQ ID NO: 2218 - DNA, 25 bp, Artificial Sequence
  Synthetic oligonucleotide
ggcuaacaagaauaaauacauggga

SEQ ID NO: 2219 - DNA, 25 bp, Artificial Sequence
  Synthetic oligonucleotide
gaagagucacugucugaaagaagca

SEQ ID NO: 2220 - DNA, 25 bp, Artificial Sequence
  Synthetic oligonucleotide
agucacugucugaaagaagcaaagt

SEQ ID NO: 2221 - DNA, 25 bp, Artificial Sequence
  Synthetic oligonucleotide
cacugucugaaagaagcaaaguuca

SEQ ID NO: 2222 - DNA, 25 bp, Artificial Sequence
  Synthetic oligonucleotide
guagccaggcaagucauagaauuga

SEQ ID NO: 2223 - DNA, 25 bp, Artificial Sequence
  Synthetic oligonucleotide
caggcaagucauagaauugauuacc

SEQ ID NO: 2224 - DNA, 25 bp, Artificial Sequence
  Synthetic oligonucleotide
gauuacccgccgaauucauuaautt

SEQ ID NO: 2225 - DNA, 25 bp, Artificial Sequence
  Synthetic oligonucleotide
ccgccgaauucauuaauuuacugta

SEQ ID NO: 2226 - DNA, 25 bp, Artificial Sequence
  Synthetic oligonucleotide
gaauucauuaauuuacuguagugtt

SEQ ID NO: 2227 - DNA, 25 bp, Artificial Sequence
  Synthetic oligonucleotide
ccaaguguucaggacuuuuauacct

SEQ ID NO: 2228 - DNA, 25 bp, Artificial Sequence
  Synthetic oligonucleotide
aaguguucaggacuuuuauaccugt

SEQ ID NO: 2229 - DNA, 25 bp, Artificial Sequence
  Synthetic oligonucleotide
ucaggacuuuuauaccuguuauact

SEQ ID NO: 2230 - DNA, 25 bp, Artificial Sequence
  Synthetic oligonucleotide
aggacuuuuauaccuguuauacutt

SEQ ID NO: 2231 - DNA, 25 bp, Artificial Sequence
  Synthetic oligonucleotide
cuuuuauaccuguuauacuuuggct

SEQ ID NO: 2232 - DNA, 25 bp, Artificial Sequence
  Synthetic oligonucleotide
cuaguuuaucaccaauaauacuuga

SEQ ID NO: 2233 - DNA, 25 bp, Artificial Sequence
  Synthetic oligonucleotide
gacggaaggcucaguaauuaguuat

SEQ ID NO: 2234 - DNA, 25 bp, Artificial Sequence
  Synthetic oligonucleotide
cggaaggcucaguaauuaguuauga

SEQ ID NO: 2235 - DNA, 25 bp, Artificial Sequence
  Synthetic oligonucleotide
gaaggcucaguaauuaguuaugaat

SEQ ID NO: 2236 - DNA, 25 bp, Artificial Sequence
  Synthetic oligonucleotide
cucaguaauuaguuaugaauaugga

SEQ ID NO: 2237 - DNA, 25 bp, Artificial Sequence
  Synthetic oligonucleotide
caguaauuaguuaugaauauggata

SEQ ID NO: 2238 - DNA, 25 bp, Artificial Sequence
  Synthetic oligonucleotide
gacagcuuguaaauguauuuguaaa

SEQ ID NO: 2239 - DNA, 25 bp, Artificial Sequence
  Synthetic oligonucleotide
agcuuguaaauguauuuguaaaaat

SEQ ID NO: 2240 - DNA, 25 bp, Artificial Sequence
  Synthetic oligonucleotide
gaaagucuauuucuuugaaacgaag

SEQ ID NO: 2241 - DNA, 25 bp, Artificial Sequence
  Synthetic oligonucleotide
cgaauuuacauuaguuuuuuucata

SEQ ID NO: 2242 - DNA, 25 bp, Artificial Sequence
  Synthetic oligonucleotide
cauuaguuuuuuucauacccuuutg

SEQ ID NO: 2243 - DNA, 25 bp, Artificial Sequence
  Synthetic oligonucleotide
uuaguuuuuuucauacccuuuugaa

SEQ ID NO: 2244 - DNA, 25 bp, Artificial Sequence
  Synthetic oligonucleotide
cauacccuuuugaacuuugcaactt

SEQ ID NO: 2245 - DNA, 25 bp, Artificial Sequence
  Synthetic oligonucleotide
cuuuucuaugcuaaacuuuguuctg

SEQ ID NO: 2246 - DNA, 25 bp, Artificial Sequence
  Synthetic oligonucleotide
cuaaacuuuguucuguucaguucta

SEQ ID NO: 2247 - DNA, 25 bp, Artificial Sequence
  Synthetic oligonucleotide
aaacuuuguucuguucaguucuaga

SEQ ID NO: 2248 - DNA, 25 bp, Artificial Sequence
  Synthetic oligonucleotide
guaugcagacugguuguaguggaac

SEQ ID NO: 2249 - DNA, 25 bp, Artificial Sequence
  Synthetic oligonucleotide
gcagacugguuguaguggaacaaat

SEQ ID NO: 2250 - DNA, 25 bp, Artificial Sequence
  Synthetic oligonucleotide
ggaacaaaucugauaacuaugcagg

SEQ ID NO: 2251 - DNA, 25 bp, Artificial Sequence
  Synthetic oligonucleotide
gagagguugaugaauggaaauuctt

SEQ ID NO: 2252 - DNA, 25 bp, Artificial Sequence
  Synthetic oligonucleotide
auggaaauucuuucacuucauuata

SEQ ID NO: 2253 - DNA, 25 bp, Artificial Sequence
  Synthetic oligonucleotide
gaaauucuuucacuucauuauaugc

SEQ ID NO: 2254 - DNA, 25 bp, Artificial Sequence
  Synthetic oligonucleotide
aauucuuucacuucauuauaugcaa

SEQ ID NO: 2255 - DNA, 25 bp, Artificial Sequence
  Synthetic oligonucleotide
cacuucauuauaugcaaguuuucaa

SEQ ID NO: 2256 - DNA, 25 bp, Artificial Sequence
  Synthetic oligonucleotide
cuucauuauaugcaaguuuucaata

SEQ ID NO: 2257 - DNA, 25 bp, Artificial Sequence
  Synthetic oligonucleotide
cauuauaugcaaguuuucaauaatt

SEQ ID NO: 2258 - DNA, 25 bp, Artificial Sequence
  Synthetic oligonucleotide
uuauaugcaaguuuucaauaauuag

SEQ ID NO: 2259 - DNA, 25 bp, Artificial Sequence
  Synthetic oligonucleotide
augcaaguuuucaauaauuagguct

SEQ ID NO: 2260 - DNA, 25 bp, Artificial Sequence
  Synthetic oligonucleotide
gguuacugaugacuuacaaauaatg

SEQ ID NO: 2261 - DNA, 25 bp, Artificial Sequence
  Synthetic oligonucleotide
cugauugggcaauacucauuugagt

SEQ ID NO: 2262 - DNA, 25 bp, Artificial Sequence
  Synthetic oligonucleotide
aauacucauuugaguuccuuccatt

SEQ ID NO: 2263 - DNA, 25 bp, Artificial Sequence
  Synthetic oligonucleotide
cuggugaaauuuaaagugaauucat

SEQ ID NO: 2264 - DNA, 25 bp, Artificial Sequence
  Synthetic oligonucleotide
cauuugaucccuuguuugcuuaata

SEQ ID NO: 2265 - DNA, 25 bp, Artificial Sequence
  Synthetic oligonucleotide
gaucccuuguuugcuuaauaaauta

SEQ ID NO: 2266 - DNA, 25 bp, Artificial Sequence
  Synthetic oligonucleotide
cuuguuugcuuaauaaauuauaaaa

SEQ ID NO: 2267 - DNA, 25 bp, Artificial Sequence
  Synthetic oligonucleotide
guuugcuuaauaaauuauaaaauga

SEQ ID NO: 2268 - DNA, 25 bp, Artificial Sequence
  Synthetic oligonucleotide
uauaaaaugauggcuuggaaaagca

SEQ ID NO: 2269 - DNA, 25 bp, Artificial Sequence
  Synthetic oligonucleotide
ggucuaagccuaguaugucaauaaa

SEQ ID NO: 2270 - DNA, 25 bp, Artificial Sequence
  Synthetic oligonucleotide
cuaguaugucaauaaagcaaauact

SEQ ID NO: 2271 - DNA, 25 bp, Artificial Sequence
  Synthetic oligonucleotide
gucaauaaagcaaauacuuacugtt

SEQ ID NO: 2272 - DNA, 25 bp, Artificial Sequence
  Synthetic oligonucleotide
caauaaagcaaauacuuacuguutt

SEQ ID NO: 2273 - DNA, 25 bp, Artificial Sequence
  Synthetic oligonucleotide
uaaagcaaauacuuacuguuuugtt

SEQ ID NO: 2274 - DNA, 25 bp, Artificial Sequence
  Synthetic oligonucleotide
aagcaaauacuuacuguuuuguutc

SEQ ID NO: 2275 - DNA, 25 bp, Artificial Sequence
  Synthetic oligonucleotide
aaauacuuacuguuuuguuucuatt

SEQ ID NO: 2276 - DNA, 25 bp, Artificial Sequence
  Synthetic oligonucleotide
uacuuacuguuuuguuucuauuaat

SEQ ID NO: 2277 - DNA, 25 bp, Artificial Sequence
  Synthetic oligonucleotide
cuuacuguuuuguuucuauuaauga

SEQ ID NO: 2278 - DNA, 25 bp, Artificial Sequence
  Synthetic oligonucleotide
uacuguuuuguuucuauuaaugatt

SEQ ID NO: 2279 - DNA, 25 bp, Artificial Sequence
  Synthetic oligonucleotide
guuuuguuucuauuaaugauuccca

SEQ ID NO: 2280 - DNA, 25 bp, Artificial Sequence
  Synthetic oligonucleotide
uuaaugauucccaaaccuuguugca

SEQ ID NO: 2281 - DNA, 25 bp, Artificial Sequence
  Synthetic oligonucleotide
caaaccuuguugcaaguuuuugcat

SEQ ID NO: 2282 - DNA, 25 bp, Artificial Sequence
  Synthetic oligonucleotide
gauuucagucuugauguuuguucta

SEQ ID NO: 2283 - DNA, 25 bp, Artificial Sequence
  Synthetic oligonucleotide
gucuugauguuuguucuaucagact

SEQ ID NO: 2284 - DNA, 25 bp, Artificial Sequence
  Synthetic oligonucleotide
cugccaucccugaacucuuucuagc

SEQ ID NO: 2285 - DNA, 25 bp, Artificial Sequence
  Synthetic oligonucleotide
cugaacucuuucuagcccuuuuaga

SEQ ID NO: 2286 - DNA, 25 bp, Artificial Sequence
  Synthetic oligonucleotide
gaacucuuucuagcccuuuuagatt

SEQ ID NO: 2287 - DNA, 25 bp, Artificial Sequence
  Synthetic oligonucleotide
gauccuguuagcaggugguaauacc

SEQ ID NO: 2288 - DNA, 25 bp, Artificial Sequence
  Synthetic oligonucleotide
gacugguaucuuuucaacuauugtt

SEQ ID NO: 2289 - DNA, 25 bp, Artificial Sequence
  Synthetic oligonucleotide
aagaacauuuuaugaggcuuucuct

SEQ ID NO: 2290 - DNA, 25 bp, Artificial Sequence
  Synthetic oligonucleotide
gaacauuuuaugaggcuuucucuaa

SEQ ID NO: 2291 - DNA, 25 bp, Artificial Sequence
  Synthetic oligonucleotide
agucuguggacuccauuuaaaaata

SEQ ID NO: 2292 - DNA, 25 bp, Artificial Sequence
  Synthetic oligonucleotide
cauuagguaugacuguggaaauaca

SEQ ID NO: 2293 - DNA, 25 bp, Artificial Sequence
  Synthetic oligonucleotide
gacaaggaucuuaguugauauuutg

SEQ ID NO: 2294 - DNA, 25 bp, Artificial Sequence
  Synthetic oligonucleotide
gacuacuuuuugacuucuguuugtc

SEQ ID NO: 2295 - DNA, 25 bp, Artificial Sequence
  Synthetic oligonucleotide
cuguuuuuccugagaaaaaaaaata

SEQ ID NO: 2296 - DNA, 25 bp, Artificial Sequence
  Synthetic oligonucleotide
guuuuuccugagaaaaaaaaauaaa

SEQ ID NO: 2297 - DNA, 25 bp, Artificial Sequence
  Synthetic oligonucleotide
ccugagaaaaaaaaauaaaucuutt

SEQ ID NO: 2298 - DNA, 25 bp, Artificial Sequence
  Synthetic oligonucleotide
gagaaaaaaaaauaaaucuuuuatt

SEQ ID NO: 2299 - DNA, 25 bp, Artificial Sequence
  Synthetic oligonucleotide
gaaaaaaaaauaaaucuuuuauuca

SEQ ID NO: 2300 - DNA, 25 bp, Artificial Sequence
  Synthetic oligonucleotide
aaaauaaaucuuuuauucaaaaaaa

SEQ ID NO: 2301 - DNA, 25 bp, Artificial Sequence
  Synthetic oligonucleotide
cuggaagagucacugucugaaugaa

SEQ ID NO: 2302 - RNA, 27 nt, Artificial Sequence
  Synthetic oligonucleotide
gagacaacgauuucacaucgucuucgu

SEQ ID NO: 2303 - RNA, 27 nt, Artificial Sequence
  Synthetic oligonucleotide
caaaagaaaugagagucacaauccugc

SEQ ID NO: 2304 - RNA, 27 nt, Artificial Sequence
  Synthetic oligonucleotide
accaaaagaaaugagagucacaauccu

SEQ ID NO: 2305 - RNA, 27 nt, Artificial Sequence
  Synthetic oligonucleotide
ucaaguguuuagccacaaaggcaccaa

SEQ ID NO: 2306 - RNA, 27 nt, Artificial Sequence
  Synthetic oligonucleotide
ucuucaaguguuuagccacaaaggcac

SEQ ID NO: 2307 - RNA, 27 nt, Artificial Sequence
  Synthetic oligonucleotide
ucuacauggaagaacuccacaaaccca

SEQ ID NO: 2308 - RNA, 27 nt, Artificial Sequence
  Synthetic oligonucleotide
uugcuuuucuggcuagguugcuagggu

SEQ ID NO: 2309 - RNA, 27 nt, Artificial Sequence
  Synthetic oligonucleotide
ccacuugcuuuucuggcuagguugcua

SEQ ID NO: 2310 - RNA, 27 nt, Artificial Sequence
  Synthetic oligonucleotide
cauaauccucuugccacuugcuuuucu

SEQ ID NO: 2311 - RNA, 27 nt, Artificial Sequence
  Synthetic oligonucleotide
uauucuuguuagccauaauccucuugc

SEQ ID NO: 2312 - RNA, 27 nt, Artificial Sequence
  Synthetic oligonucleotide
uauuuauucuuguuagccauaauccuc

SEQ ID NO: 2313 - RNA, 27 nt, Artificial Sequence
  Synthetic oligonucleotide
uguauuuauucuuguuagccauaaucc

SEQ ID NO: 2314 - RNA, 27 nt, Artificial Sequence
  Synthetic oligonucleotide
ucccauguauuuauucuuguuagccau

SEQ ID NO: 2315 - RNA, 27 nt, Artificial Sequence
  Synthetic oligonucleotide
ugcuucuuucagacagugacucuucaa

SEQ ID NO: 2316 - RNA, 27 nt, Artificial Sequence
  Synthetic oligonucleotide
acuuugcuucuuucagacagugacucu

SEQ ID NO: 2317 - RNA, 27 nt, Artificial Sequence
  Synthetic oligonucleotide
ugaacuuugcuucuuucagacagugac

SEQ ID NO: 2318 - RNA, 27 nt, Artificial Sequence
  Synthetic oligonucleotide
ucaauucuaugacuugccuggcuacug

SEQ ID NO: 2319 - RNA, 27 nt, Artificial Sequence
  Synthetic oligonucleotide
gguaaucaauucuaugacuugccuggc

SEQ ID NO: 2320 - RNA, 27 nt, Artificial Sequence
  Synthetic oligonucleotide
aaauuaaugaauucggcggguaaucaa

SEQ ID NO: 2321 - RNA, 27 nt, Artificial Sequence
  Synthetic oligonucleotide
uacaguaaauuaaugaauucggcgggu

SEQ ID NO: 2322 - RNA, 27 nt, Artificial Sequence
  Synthetic oligonucleotide
aacacuacaguaaauuaaugaauucgg

SEQ ID NO: 2323 - RNA, 27 nt, Artificial Sequence
  Synthetic oligonucleotide
agguauaaaaguccugaacacuuggac

SEQ ID NO: 2324 - RNA, 27 nt, Artificial Sequence
  Synthetic oligonucleotide
acagguauaaaaguccugaacacuugg

SEQ ID NO: 2325 - RNA, 27 nt, Artificial Sequence
  Synthetic oligonucleotide
aguauaacagguauaaaaguccugaac

SEQ ID NO: 2326 - RNA, 27 nt, Artificial Sequence
  Synthetic oligonucleotide
aaaguauaacagguauaaaaguccuga

SEQ ID NO: 2327 - RNA, 27 nt, Artificial Sequence
  Synthetic oligonucleotide
agccaaaguauaacagguauaaaaguc

SEQ ID NO: 2328 - RNA, 27 nt, Artificial Sequence
  Synthetic oligonucleotide
ucaaguauuauuggugauaaacuaggc

SEQ ID NO: 2329 - RNA, 27 nt, Artificial Sequence
  Synthetic oligonucleotide
auaacuaauuacugagccuuccgucaa

SEQ ID NO: 2330 - RNA, 27 nt, Artificial Sequence
  Synthetic oligonucleotide
ucauaacuaauuacugagccuuccguc

SEQ ID NO: 2331 - RNA, 27 nt, Artificial Sequence
  Synthetic oligonucleotide
auucauaacuaauuacugagccuuccg

SEQ ID NO: 2332 - RNA, 27 nt, Artificial Sequence
  Synthetic oligonucleotide
uccauauucauaacuaauuacugagcc

SEQ ID NO: 2333 - RNA, 27 nt, Artificial Sequence
  Synthetic oligonucleotide
uauccauauucauaacuaauuacugag

SEQ ID NO: 2334 - RNA, 27 nt, Artificial Sequence
  Synthetic oligonucleotide
uuuacaaauacauuuacaagcugucuu

SEQ ID NO: 2335 - RNA, 27 nt, Artificial Sequence
  Synthetic oligonucleotide
auuuuuacaaauacauuuacaagcugu

SEQ ID NO: 2336 - RNA, 27 nt, Artificial Sequence
  Synthetic oligonucleotide
cuucguuucaaagaaauagacuuucug

SEQ ID NO: 2337 - RNA, 27 nt, Artificial Sequence
  Synthetic oligonucleotide
uaugaaaaaaacuaauguaaauucgau

SEQ ID NO: 2338 - RNA, 27 nt, Artificial Sequence
  Synthetic oligonucleotide
caaaaggguaugaaaaaaacuaaugua

SEQ ID NO: 2339 - RNA, 27 nt, Artificial Sequence
  Synthetic oligonucleotide
uucaaaaggguaugaaaaaaacuaaug

SEQ ID NO: 2340 - RNA, 27 nt, Artificial Sequence
  Synthetic oligonucleotide
aaguugcaaaguucaaaaggguaugaa

SEQ ID NO: 2341 - RNA, 27 nt, Artificial Sequence
  Synthetic oligonucleotide
cagaacaaaguuuagcauagaaaagcu

SEQ ID NO: 2342 - RNA, 27 nt, Artificial Sequence
  Synthetic oligonucleotide
uagaacugaacagaacaaaguuuagca

SEQ ID NO: 2343 - RNA, 27 nt, Artificial Sequence
  Synthetic oligonucleotide
ucuagaacugaacagaacaaaguuuag

SEQ ID NO: 2344 - RNA, 27 nt, Artificial Sequence
  Synthetic oligonucleotide
guuccacuacaaccagucugcauacag

SEQ ID NO: 2345 - RNA, 27 nt, Artificial Sequence
  Synthetic oligonucleotide
auuuguuccacuacaaccagucugcau

SEQ ID NO: 2346 - RNA, 27 nt, Artificial Sequence
  Synthetic oligonucleotide
ccugcauaguuaucagauuuguuccac

SEQ ID NO: 2347 - RNA, 27 nt, Artificial Sequence
  Synthetic oligonucleotide
aagaauuuccauucaucaaccucucaa

SEQ ID NO: 2348 - RNA, 27 nt, Artificial Sequence
  Synthetic oligonucleotide
uauaaugaagugaaagaauuuccauuc

SEQ ID NO: 2349 - RNA, 27 nt, Artificial Sequence
  Synthetic oligonucleotide
gcauauaaugaagugaaagaauuucca

SEQ ID NO: 2350 - RNA, 27 nt, Artificial Sequence
  Synthetic oligonucleotide
uugcauauaaugaagugaaagaauuuc

SEQ ID NO: 2351 - RNA, 27 nt, Artificial Sequence
  Synthetic oligonucleotide
uugaaaacuugcauauaaugaagugaa

SEQ ID NO: 2352 - RNA, 27 nt, Artificial Sequence
  Synthetic oligonucleotide
uauugaaaacuugcauauaaugaagug

SEQ ID NO: 2353 - RNA, 27 nt, Artificial Sequence
  Synthetic oligonucleotide
aauuauugaaaacuugcauauaaugaa

SEQ ID NO: 2354 - RNA, 27 nt, Artificial Sequence
  Synthetic oligonucleotide
cuaauuauugaaaacuugcauauaaug

SEQ ID NO: 2355 - RNA, 27 nt, Artificial Sequence
  Synthetic oligonucleotide
agaccuaauuauugaaaacuugcauau

SEQ ID NO: 2356 - RNA, 27 nt, Artificial Sequence
  Synthetic oligonucleotide
cauuauuuguaagucaucaguaaccuu

SEQ ID NO: 2357 - RNA, 27 nt, Artificial Sequence
  Synthetic oligonucleotide
acucaaaugaguauugcccaaucagag

SEQ ID NO: 2358 - RNA, 27 nt, Artificial Sequence
  Synthetic oligonucleotide
aauggaaggaacucaaaugaguauugc

SEQ ID NO: 2359 - RNA, 27 nt, Artificial Sequence
  Synthetic oligonucleotide
augaauucacuuuaaauuucaccaguu

SEQ ID NO: 2360 - RNA, 27 nt, Artificial Sequence
  Synthetic oligonucleotide
uauuaagcaaacaagggaucaaauguc

SEQ ID NO: 2361 - RNA, 27 nt, Artificial Sequence
  Synthetic oligonucleotide
uaauuuauuaagcaaacaagggaucaa

SEQ ID NO: 2362 - RNA, 27 nt, Artificial Sequence
  Synthetic oligonucleotide
uuuuauaauuuauuaagcaaacaaggg

SEQ ID NO: 2363 - RNA, 27 nt, Artificial Sequence
  Synthetic oligonucleotide
ucauuuuauaauuuauuaagcaaacaa

SEQ ID NO: 2364 - RNA, 27 nt, Artificial Sequence
  Synthetic oligonucleotide
ugcuuuuccaagccaucauuuuauaau

SEQ ID NO: 2365 - RNA, 27 nt, Artificial Sequence
  Synthetic oligonucleotide
uuuauugacauacuaggcuuagaccug

SEQ ID NO: 2366 - RNA, 27 nt, Artificial Sequence
  Synthetic oligonucleotide
aguauuugcuuuauugacauacuaggc

SEQ ID NO: 2367 - RNA, 27 nt, Artificial Sequence
  Synthetic oligonucleotide
aacaguaaguauuugcuuuauugacau

SEQ ID NO: 2368 - RNA, 27 nt, Artificial Sequence
  Synthetic oligonucleotide
aaaacaguaaguauuugcuuuauugac

SEQ ID NO: 2369 - RNA, 27 nt, Artificial Sequence
  Synthetic oligonucleotide
aacaaaacaguaaguauuugcuuuauu

SEQ ID NO: 2370 - RNA, 27 nt, Artificial Sequence
  Synthetic oligonucleotide
gaaacaaaacaguaaguauuugcuuua

SEQ ID NO: 2371 - RNA, 27 nt, Artificial Sequence
  Synthetic oligonucleotide
aauagaaacaaaacaguaaguauuugc

SEQ ID NO: 2372 - RNA, 27 nt, Artificial Sequence
  Synthetic oligonucleotide
auuaauagaaacaaaacaguaaguauu

SEQ ID NO: 2373 - RNA, 27 nt, Artificial Sequence
  Synthetic oligonucleotide
ucauuaauagaaacaaaacaguaagua

SEQ ID NO: 2374 - RNA, 27 nt, Artificial Sequence
  Synthetic oligonucleotide
aaucauuaauagaaacaaaacaguaag

SEQ ID NO: 2375 - RNA, 27 nt, Artificial Sequence
  Synthetic oligonucleotide
ugggaaucauuaauagaaacaaaacag

SEQ ID NO: 2376 - RNA, 27 nt, Artificial Sequence
  Synthetic oligonucleotide
ugcaacaagguuugggaaucauuaaua

SEQ ID NO: 2377 - RNA, 27 nt, Artificial Sequence
  Synthetic oligonucleotide
augcaaaaacuugcaacaagguuuggg

SEQ ID NO: 2378 - RNA, 27 nt, Artificial Sequence
  Synthetic oligonucleotide
uagaacaaacaucaagacugaaaucca

SEQ ID NO: 2379 - RNA, 27 nt, Artificial Sequence
  Synthetic oligonucleotide
agucugauagaacaaacaucaagacug

SEQ ID NO: 2380 - RNA, 27 nt, Artificial Sequence
  Synthetic oligonucleotide
gcuagaaagaguucagggauggcaggg

SEQ ID NO: 2381 - RNA, 27 nt, Artificial Sequence
  Synthetic oligonucleotide
ucuaaaagggcuagaaagaguucaggg

SEQ ID NO: 2382 - RNA, 27 nt, Artificial Sequence
  Synthetic oligonucleotide
aaucuaaaagggcuagaaagaguucag

SEQ ID NO: 2383 - RNA, 27 nt, Artificial Sequence
  Synthetic oligonucleotide
gguauuaccaccugcuaacaggaucaa

SEQ ID NO: 2384 - RNA, 27 nt, Artificial Sequence
  Synthetic oligonucleotide
aacaauaguugaaaagauaccagucca

SEQ ID NO: 2385 - RNA, 27 nt, Artificial Sequence
  Synthetic oligonucleotide
agagaaagccucauaaaauguucuuuc

SEQ ID NO: 2386 - RNA, 27 nt, Artificial Sequence
  Synthetic oligonucleotide
uuagagaaagccucauaaaauguucuu

SEQ ID NO: 2387 - RNA, 27 nt, Artificial Sequence
  Synthetic oligonucleotide
uauuuuuaaauggaguccacagacuaa

SEQ ID NO: 2388 - RNA, 27 nt, Artificial Sequence
  Synthetic oligonucleotide
uguauuuccacagucauaccuaaugaa

SEQ ID NO: 2389 - RNA, 27 nt, Artificial Sequence
  Synthetic oligonucleotide
caaaauaucaacuaagauccuugucug

SEQ ID NO: 2390 - RNA, 27 nt, Artificial Sequence
  Synthetic oligonucleotide
gacaaacagaagucaaaaaguagucac

SEQ ID NO: 2391 - RNA, 27 nt, Artificial Sequence
  Synthetic oligonucleotide
uauuuuuuuuucucaggaaaaacagaa

SEQ ID NO: 2392 - RNA, 27 nt, Artificial Sequence
  Synthetic oligonucleotide
uuuauuuuuuuuucucaggaaaaacag

SEQ ID NO: 2393 - RNA, 27 nt, Artificial Sequence
  Synthetic oligonucleotide
aaaagauuuauuuuuuuuucucaggaa

SEQ ID NO: 2394 - RNA, 27 nt, Artificial Sequence
  Synthetic oligonucleotide
aauaaaagauuuauuuuuuuuucucag

SEQ ID NO: 2395 - RNA, 27 nt, Artificial Sequence
  Synthetic oligonucleotide
ugaauaaaagauuuauuuuuuuuucuc

SEQ ID NO: 2396 - RNA, 27 nt, Artificial Sequence
  Synthetic oligonucleotide
uuuuuuugaauaaaagauuuauuuuuu

SEQ ID NO: 2397 - RNA, 27 nt, Artificial Sequence
  Synthetic oligonucleotide
uucauucagacagugacucuuccaggg

SEQ ID NO: 2398 - DNA, 27 bp, Artificial Sequence
  Synthetic oligonucleotide
acgaagacgatgtgaaatcgttgtctc

SEQ ID NO: 2399 - DNA, 27 bp, Artificial Sequence
  Synthetic oligonucleotide
gcaggattgtgactctcatttcttttg

SEQ ID NO: 2400 - DNA, 27 bp, Artificial Sequence
  Synthetic oligonucleotide
aggattgtgactctcatttcttttggt

SEQ ID NO: 2401 - DNA, 27 bp, Artificial Sequence
  Synthetic oligonucleotide
ttggtgcctttgtggctaaacacttga

SEQ ID NO: 2402 - DNA, 27 bp, Artificial Sequence
  Synthetic oligonucleotide
gtgcctttgtggctaaacacttgaaga

SEQ ID NO: 2403 - DNA, 27 bp, Artificial Sequence
  Synthetic oligonucleotide
tgggtttgtggagttcttccatgtaga

SEQ ID NO: 2404 - DNA, 27 bp, Artificial Sequence
  Synthetic oligonucleotide
accctagcaacctagccagaaaagcaa

SEQ ID NO: 2405 - DNA, 27 bp, Artificial Sequence
  Synthetic oligonucleotide
tagcaacctagccagaaaagcaagtgg

SEQ ID NO: 2406 - DNA, 27 bp, Artificial Sequence
  Synthetic oligonucleotide
agaaaagcaagtggcaagaggattatg

SEQ ID NO: 2407 - DNA, 27 bp, Artificial Sequence
  Synthetic oligonucleotide
gcaagaggattatggctaacaagaata

SEQ ID NO: 2408 - DNA, 27 bp, Artificial Sequence
  Synthetic oligonucleotide
gaggattatggctaacaagaataaata

SEQ ID NO: 2409 - DNA, 27 bp, Artificial Sequence
  Synthetic oligonucleotide
ggattatggctaacaagaataaataca

SEQ ID NO: 2410 - DNA, 27 bp, Artificial Sequence
  Synthetic oligonucleotide
atggctaacaagaataaatacatggga

SEQ ID NO: 2411 - DNA, 27 bp, Artificial Sequence
  Synthetic oligonucleotide
ttgaagagtcactgtctgaaagaagca

SEQ ID NO: 2412 - DNA, 27 bp, Artificial Sequence
  Synthetic oligonucleotide
agagtcactgtctgaaagaagcaaagt

SEQ ID NO: 2413 - DNA, 27 bp, Artificial Sequence
  Synthetic oligonucleotide
gtcactgtctgaaagaagcaaagttca

SEQ ID NO: 2414 - DNA, 27 bp, Artificial Sequence
  Synthetic oligonucleotide
cagtagccaggcaagtcatagaattga

SEQ ID NO: 2415 - DNA, 27 bp, Artificial Sequence
  Synthetic oligonucleotide
gccaggcaagtcatagaattgattacc

SEQ ID NO: 2416 - DNA, 27 bp, Artificial Sequence
  Synthetic oligonucleotide
ttgattacccgccgaattcattaattt

SEQ ID NO: 2417 - DNA, 27 bp, Artificial Sequence
  Synthetic oligonucleotide
acccgccgaattcattaatttactgta

SEQ ID NO: 2418 - DNA, 27 bp, Artificial Sequence
  Synthetic oligonucleotide
ccgaattcattaatttactgtagtgtt

SEQ ID NO: 2419 - DNA, 27 bp, Artificial Sequence
  Synthetic oligonucleotide
gtccaagtgttcaggacttttatacct

SEQ ID NO: 2420 - DNA, 27 bp, Artificial Sequence
  Synthetic oligonucleotide
ccaagtgttcaggacttttatacctgt

SEQ ID NO: 2421 - DNA, 27 bp, Artificial Sequence
  Synthetic oligonucleotide
gttcaggacttttatacctgttatact

SEQ ID NO: 2422 - DNA, 27 bp, Artificial Sequence
  Synthetic oligonucleotide
tcaggacttttatacctgttatacttt

SEQ ID NO: 2423 - DNA, 27 bp, Artificial Sequence
  Synthetic oligonucleotide
gacttttatacctgttatactttggct

SEQ ID NO: 2424 - DNA, 27 bp, Artificial Sequence
  Synthetic oligonucleotide
gcctagtttatcaccaataatacttga

SEQ ID NO: 2425 - DNA, 27 bp, Artificial Sequence
  Synthetic oligonucleotide
ttgacggaaggctcagtaattagttat

SEQ ID NO: 2426 - DNA, 27 bp, Artificial Sequence
  Synthetic oligonucleotide
gacggaaggctcagtaattagttatga

SEQ ID NO: 2427 - DNA, 27 bp, Artificial Sequence
  Synthetic oligonucleotide
cggaaggctcagtaattagttatgaat

SEQ ID NO: 2428 - DNA, 27 bp, Artificial Sequence
  Synthetic oligonucleotide
ggctcagtaattagttatgaatatgga

SEQ ID NO: 2429 - DNA, 27 bp, Artificial Sequence
  Synthetic oligonucleotide
ctcagtaattagttatgaatatggata

SEQ ID NO: 2430 - DNA, 27 bp, Artificial Sequence
  Synthetic oligonucleotide
aagacagcttgtaaatgtatttgtaaa

SEQ ID NO: 2431 - DNA, 27 bp, Artificial Sequence
  Synthetic oligonucleotide
acagcttgtaaatgtatttgtaaaaat

SEQ ID NO: 2432 - DNA, 27 bp, Artificial Sequence
  Synthetic oligonucleotide
cagaaagtctatttctttgaaacgaag

SEQ ID NO: 2433 - DNA, 27 bp, Artificial Sequence
  Synthetic oligonucleotide
atcgaatttacattagtttttttcata

SEQ ID NO: 2434 - DNA, 27 bp, Artificial Sequence
  Synthetic oligonucleotide
tacattagtttttttcatacccttttg

SEQ ID NO: 2435 - DNA, 27 bp, Artificial Sequence
  Synthetic oligonucleotide
cattagtttttttcatacccttttgaa

SEQ ID NO: 2436 - DNA, 27 bp, Artificial Sequence
  Synthetic oligonucleotide
ttcatacccttttgaactttgcaactt

SEQ ID NO: 2437 - DNA, 27 bp, Artificial Sequence
  Synthetic oligonucleotide
agcttttctatgctaaactttgttctg

SEQ ID NO: 2438 - DNA, 27 bp, Artificial Sequence
  Synthetic oligonucleotide
tgctaaactttgttctgttcagttcta

SEQ ID NO: 2439 - DNA, 27 bp, Artificial Sequence
  Synthetic oligonucleotide
ctaaactttgttctgttcagttctaga

SEQ ID NO: 2440 - DNA, 27 bp, Artificial Sequence
  Synthetic oligonucleotide
ctgtatgcagactggttgtagtggaac

SEQ ID NO: 2441 - DNA, 27 bp, Artificial Sequence
  Synthetic oligonucleotide
atgcagactggttgtagtggaacaaat

SEQ ID NO: 2442 - DNA, 27 bp, Artificial Sequence
  Synthetic oligonucleotide
gtggaacaaatctgataactatgcagg

SEQ ID NO: 2443 - DNA, 27 bp, Artificial Sequence
  Synthetic oligonucleotide
ttgagaggttgatgaatggaaattctt

SEQ ID NO: 2444 - DNA, 27 bp, Artificial Sequence
  Synthetic oligonucleotide
gaatggaaattctttcacttcattata

SEQ ID NO: 2445 - DNA, 27 bp, Artificial Sequence
  Synthetic oligonucleotide
tggaaattctttcacttcattatatgc

SEQ ID NO: 2446 - DNA, 27 bp, Artificial Sequence
  Synthetic oligonucleotide
gaaattctttcacttcattatatgcaa

SEQ ID NO: 2447 - DNA, 27 bp, Artificial Sequence
  Synthetic oligonucleotide
ttcacttcattatatgcaagttttcaa

SEQ ID NO: 2448 - DNA, 27 bp, Artificial Sequence
  Synthetic oligonucleotide
cacttcattatatgcaagttttcaata

SEQ ID NO: 2449 - DNA, 27 bp, Artificial Sequence
  Synthetic oligonucleotide
ttcattatatgcaagttttcaataatt

SEQ ID NO: 2450 - DNA, 27 bp, Artificial Sequence
  Synthetic oligonucleotide
cattatatgcaagttttcaataattag

SEQ ID NO: 2451 - DNA, 27 bp, Artificial Sequence
  Synthetic oligonucleotide
atatgcaagttttcaataattaggtct

SEQ ID NO: 2452 - DNA, 27 bp, Artificial Sequence
  Synthetic oligonucleotide
aaggttactgatgacttacaaataatg

SEQ ID NO: 2453 - DNA, 27 bp, Artificial Sequence
  Synthetic oligonucleotide
ctctgattgggcaatactcatttgagt

SEQ ID NO: 2454 - DNA, 27 bp, Artificial Sequence
  Synthetic oligonucleotide
gcaatactcatttgagttccttccatt

SEQ ID NO: 2455 - DNA, 27 bp, Artificial Sequence
  Synthetic oligonucleotide
aactggtgaaatttaaagtgaattcat

SEQ ID NO: 2456 - DNA, 27 bp, Artificial Sequence
  Synthetic oligonucleotide
gacatttgatcccttgtttgcttaata

SEQ ID NO: 2457 - DNA, 27 bp, Artificial Sequence
  Synthetic oligonucleotide
ttgatcccttgtttgcttaataaatta

SEQ ID NO: 2458 - DNA, 27 bp, Artificial Sequence
  Synthetic oligonucleotide
cccttgtttgcttaataaattataaaa

SEQ ID NO: 2459 - DNA, 27 bp, Artificial Sequence
  Synthetic oligonucleotide
ttgtttgcttaataaattataaaatga

SEQ ID NO: 2460 - DNA, 27 bp, Artificial Sequence
  Synthetic oligonucleotide
attataaaatgatggcttggaaaagca

SEQ ID NO: 2461 - DNA, 27 bp, Artificial Sequence
  Synthetic oligonucleotide
caggtctaagcctagtatgtcaataaa

SEQ ID NO: 2462 - DNA, 27 bp, Artificial Sequence
  Synthetic oligonucleotide
gcctagtatgtcaataaagcaaatact

SEQ ID NO: 2463 - DNA, 27 bp, Artificial Sequence
  Synthetic oligonucleotide
atgtcaataaagcaaatacttactgtt

SEQ ID NO: 2464 - DNA, 27 bp, Artificial Sequence
  Synthetic oligonucleotide
gtcaataaagcaaatacttactgtttt

SEQ ID NO: 2465 - DNA, 27 bp, Artificial Sequence
  Synthetic oligonucleotide
aataaagcaaatacttactgttttgtt

SEQ ID NO: 2466 - DNA, 27 bp, Artificial Sequence
  Synthetic oligonucleotide
taaagcaaatacttactgttttgtttc

SEQ ID NO: 2467 - DNA, 27 bp, Artificial Sequence
  Synthetic oligonucleotide
gcaaatacttactgttttgtttctatt

SEQ ID NO: 2468 - DNA, 27 bp, Artificial Sequence
  Synthetic oligonucleotide
aatacttactgttttgtttctattaat

SEQ ID NO: 2469 - DNA, 27 bp, Artificial Sequence
  Synthetic oligonucleotide
tacttactgttttgtttctattaatga

SEQ ID NO: 2470 - DNA, 27 bp, Artificial Sequence
  Synthetic oligonucleotide
cttactgttttgtttctattaatgatt

SEQ ID NO: 2471 - DNA, 27 bp, Artificial Sequence
  Synthetic oligonucleotide
ctgttttgtttctattaatgattccca

SEQ ID NO: 2472 - DNA, 27 bp, Artificial Sequence
  Synthetic oligonucleotide
tattaatgattcccaaaccttgttgca

SEQ ID NO: 2473 - DNA, 27 bp, Artificial Sequence
  Synthetic oligonucleotide
cccaaaccttgttgcaagtttttgcat

SEQ ID NO: 2474 - DNA, 27 bp, Artificial Sequence
  Synthetic oligonucleotide
tggatttcagtcttgatgtttgttcta

SEQ ID NO: 2475 - DNA, 27 bp, Artificial Sequence
  Synthetic oligonucleotide
cagtcttgatgtttgttctatcagact

SEQ ID NO: 2476 - DNA, 27 bp, Artificial Sequence
  Synthetic oligonucleotide
ccctgccatccctgaactctttctagc

SEQ ID NO: 2477 - DNA, 27 bp, Artificial Sequence
  Synthetic oligonucleotide
ccctgaactctttctagcccttttaga

SEQ ID NO: 2478 - DNA, 27 bp, Artificial Sequence
  Synthetic oligonucleotide
ctgaactctttctagcccttttagatt

SEQ ID NO: 2479 - DNA, 27 bp, Artificial Sequence
  Synthetic oligonucleotide
ttgatcctgttagcaggtggtaatacc

SEQ ID NO: 2480 - DNA, 27 bp, Artificial Sequence
  Synthetic oligonucleotide
tggactggtatcttttcaactattgtt

SEQ ID NO: 2481 - DNA, 27 bp, Artificial Sequence
  Synthetic oligonucleotide
gaaagaacattttatgaggctttctct

SEQ ID NO: 2482 - DNA, 27 bp, Artificial Sequence
  Synthetic oligonucleotide
aagaacattttatgaggctttctctaa

SEQ ID NO: 2483 - DNA, 27 bp, Artificial Sequence
  Synthetic oligonucleotide
ttagtctgtggactccatttaaaaata

SEQ ID NO: 2484 - DNA, 27 bp, Artificial Sequence
  Synthetic oligonucleotide
ttcattaggtatgactgtggaaataca

SEQ ID NO: 2485 - DNA, 27 bp, Artificial Sequence
  Synthetic oligonucleotide
cagacaaggatcttagttgatattttg

SEQ ID NO: 2486 - DNA, 27 bp, Artificial Sequence
  Synthetic oligonucleotide
gtgactactttttgacttctgtttgtc

SEQ ID NO: 2487 - DNA, 27 bp, Artificial Sequence
  Synthetic oligonucleotide
ttctgtttttcctgagaaaaaaaaata

SEQ ID NO: 2488 - DNA, 27 bp, Artificial Sequence
  Synthetic oligonucleotide
ctgtttttcctgagaaaaaaaaataaa

SEQ ID NO: 2489 - DNA, 27 bp, Artificial Sequence
  Synthetic oligonucleotide
ttcctgagaaaaaaaaataaatctttt

SEQ ID NO: 2490 - DNA, 27 bp, Artificial Sequence
  Synthetic oligonucleotide
ctgagaaaaaaaaataaatcttttatt

SEQ ID NO: 2491 - DNA, 27 bp, Artificial Sequence
  Synthetic oligonucleotide
gagaaaaaaaaataaatcttttattca

SEQ ID NO: 2492 - DNA, 27 bp, Artificial Sequence
  Synthetic oligonucleotide
aaaaaataaatcttttattcaaaaaaa

SEQ ID NO: 2493 - DNA, 27 bp, Artificial Sequence
  Synthetic oligonucleotide
ccctggaagagtcactgtctgaatgaa

SEQ ID NO: 2494 - RNA, 25 nt, Artificial Sequence
  Synthetic oligonucleotide
gaagacgaugugaaaucguugucuc

SEQ ID NO: 2495 - RNA, 25 nt, Artificial Sequence
  Synthetic oligonucleotide
aggauugugacucucauuucuuuug

SEQ ID NO: 2496 - RNA, 25 nt, Artificial Sequence
  Synthetic oligonucleotide
gauugugacucucauuucuuuuggu

SEQ ID NO: 2497 - RNA, 25 nt, Artificial Sequence
  Synthetic oligonucleotide
ggugccuuuguggcuaaacacuuga

SEQ ID NO: 2498 - RNA, 25 nt, Artificial Sequence
  Synthetic oligonucleotide
gccuuuguggcuaaacacuugaaga

SEQ ID NO: 2499 - RNA, 25 nt, Artificial Sequence
  Synthetic oligonucleotide
gguuuguggaguucuuccauguaga

SEQ ID NO: 2500 - RNA, 25 nt, Artificial Sequence
  Synthetic oligonucleotide
ccuagcaaccuagccagaaaagcaa

SEQ ID NO: 2501 - RNA, 25 nt, Artificial Sequence
  Synthetic oligonucleotide
gcaaccuagccagaaaagcaagugg

SEQ ID NO: 2502 - RNA, 25 nt, Artificial Sequence
  Synthetic oligonucleotide
aaaagcaaguggcaagaggauuaug

SEQ ID NO: 2503 - RNA, 25 nt, Artificial Sequence
  Synthetic oligonucleotide
aagaggauuauggcuaacaagaaua

SEQ ID NO: 2504 - RNA, 25 nt, Artificial Sequence
  Synthetic oligonucleotide
ggauuauggcuaacaagaauaaaua

SEQ ID NO: 2505 - RNA, 25 nt, Artificial Sequence
  Synthetic oligonucleotide
auuauggcuaacaagaauaaauaca

SEQ ID NO: 2506 - RNA, 25 nt, Artificial Sequence
  Synthetic oligonucleotide
ggcuaacaagaauaaauacauggga

SEQ ID NO: 2507 - RNA, 25 nt, Artificial Sequence
  Synthetic oligonucleotide
gaagagucacugucugaaagaagca

SEQ ID NO: 2508 - RNA, 25 nt, Artificial Sequence
  Synthetic oligonucleotide
agucacugucugaaagaagcaaagu

SEQ ID NO: 2509 - RNA, 25 nt, Artificial Sequence
  Synthetic oligonucleotide
cacugucugaaagaagcaaaguuca

SEQ ID NO: 2510 - RNA, 25 nt, Artificial Sequence
  Synthetic oligonucleotide
guagccaggcaagucauagaauuga

SEQ ID NO: 2511 - RNA, 25 nt, Artificial Sequence
  Synthetic oligonucleotide
caggcaagucauagaauugauuacc

SEQ ID NO: 2512 - RNA, 25 nt, Artificial Sequence
  Synthetic oligonucleotide
gauuacccgccgaauucauuaauuu

SEQ ID NO: 2513 - RNA, 25 nt, Artificial Sequence
  Synthetic oligonucleotide
ccgccgaauucauuaauuuacugua

SEQ ID NO: 2514 - RNA, 25 nt, Artificial Sequence
  Synthetic oligonucleotide
gaauucauuaauuuacuguaguguu

SEQ ID NO: 2515 - RNA, 25 nt, Artificial Sequence
  Synthetic oligonucleotide
ccaaguguucaggacuuuuauaccu

SEQ ID NO: 2516 - RNA, 25 nt, Artificial Sequence
  Synthetic oligonucleotide
aaguguucaggacuuuuauaccugu

SEQ ID NO: 2517 - RNA, 25 nt, Artificial Sequence
  Synthetic oligonucleotide
ucaggacuuuuauaccuguuauacu

SEQ ID NO: 2518 - RNA, 25 nt, Artificial Sequence
  Synthetic oligonucleotide
aggacuuuuauaccuguuauacuuu

SEQ ID NO: 2519 - RNA, 25 nt, Artificial Sequence
  Synthetic oligonucleotide
cuuuuauaccuguuauacuuuggcu

SEQ ID NO: 2520 - RNA, 25 nt, Artificial Sequence
  Synthetic oligonucleotide
cuaguuuaucaccaauaauacuuga

SEQ ID NO: 2521 - RNA, 25 nt, Artificial Sequence
  Synthetic oligonucleotide
gacggaaggcucaguaauuaguuau

SEQ ID NO: 2522 - RNA, 25 nt, Artificial Sequence
  Synthetic oligonucleotide
cggaaggcucaguaauuaguuauga

SEQ ID NO: 2523 - RNA, 25 nt, Artificial Sequence
  Synthetic oligonucleotide
gaaggcucaguaauuaguuaugaau

SEQ ID NO: 2524 - RNA, 25 nt, Artificial Sequence
  Synthetic oligonucleotide
cucaguaauuaguuaugaauaugga

SEQ ID NO: 2525 - RNA, 25 nt, Artificial Sequence
  Synthetic oligonucleotide
caguaauuaguuaugaauauggaua

SEQ ID NO: 2526 - RNA, 25 nt, Artificial Sequence
  Synthetic oligonucleotide
gacagcuuguaaauguauuuguaaa

SEQ ID NO: 2527 - RNA, 25 nt, Artificial Sequence
  Synthetic oligonucleotide
agcuuguaaauguauuuguaaaaau

SEQ ID NO: 2528 - RNA, 25 nt, Artificial Sequence
  Synthetic oligonucleotide
gaaagucuauuucuuugaaacgaag

SEQ ID NO: 2529 - RNA, 25 nt, Artificial Sequence
  Synthetic oligonucleotide
cgaauuuacauuaguuuuuuucaua

SEQ ID NO: 2530 - RNA, 25 nt, Artificial Sequence
  Synthetic oligonucleotide
cauuaguuuuuuucauacccuuuug

SEQ ID NO: 2531 - RNA, 25 nt, Artificial Sequence
  Synthetic oligonucleotide
uuaguuuuuuucauacccuuuugaa

SEQ ID NO: 2532 - RNA, 25 nt, Artificial Sequence
  Synthetic oligonucleotide
cauacccuuuugaacuuugcaacuu

SEQ ID NO: 2533 - RNA, 25 nt, Artificial Sequence
  Synthetic oligonucleotide
cuuuucuaugcuaaacuuuguucug

SEQ ID NO: 2534 - RNA, 25 nt, Artificial Sequence
  Synthetic oligonucleotide
cuaaacuuuguucuguucaguucua

SEQ ID NO: 2535 - RNA, 25 nt, Artificial Sequence
  Synthetic oligonucleotide
aaacuuuguucuguucaguucuaga

SEQ ID NO: 2536 - RNA, 25 nt, Artificial Sequence
  Synthetic oligonucleotide
guaugcagacugguuguaguggaac

SEQ ID NO: 2537 - RNA, 25 nt, Artificial Sequence
  Synthetic oligonucleotide
gcagacugguuguaguggaacaaau

SEQ ID NO: 2538 - RNA, 25 nt, Artificial Sequence
  Synthetic oligonucleotide
ggaacaaaucugauaacuaugcagg

SEQ ID NO: 2539 - RNA, 25 nt, Artificial Sequence
  Synthetic oligonucleotide
gagagguugaugaauggaaauucuu

SEQ ID NO: 2540 - RNA, 25 nt, Artificial Sequence
  Synthetic oligonucleotide
auggaaauucuuucacuucauuaua

SEQ ID NO: 2541 - RNA, 25 nt, Artificial Sequence
  Synthetic oligonucleotide
gaaauucuuucacuucauuauaugc

SEQ ID NO: 2542 - RNA, 25 nt, Artificial Sequence
  Synthetic oligonucleotide
aauucuuucacuucauuauaugcaa

SEQ ID NO: 2543 - RNA, 25 nt, Artificial Sequence
  Synthetic oligonucleotide
cacuucauuauaugcaaguuuucaa

SEQ ID NO: 2544 - RNA, 25 nt, Artificial Sequence
  Synthetic oligonucleotide
cuucauuauaugcaaguuuucaaua

SEQ ID NO: 2545 - RNA, 25 nt, Artificial Sequence
  Synthetic oligonucleotide
cauuauaugcaaguuuucaauaauu

SEQ ID NO: 2546 - RNA, 25 nt, Artificial Sequence
  Synthetic oligonucleotide
uuauaugcaaguuuucaauaauuag

SEQ ID NO: 2547 - RNA, 25 nt, Artificial Sequence
  Synthetic oligonucleotide
augcaaguuuucaauaauuaggucu

SEQ ID NO: 2548 - RNA, 25 nt, Artificial Sequence
  Synthetic oligonucleotide
gguuacugaugacuuacaaauaaug

SEQ ID NO: 2549 - RNA, 25 nt, Artificial Sequence
  Synthetic oligonucleotide
cugauugggcaauacucauuugagu

SEQ ID NO: 2550 - RNA, 25 nt, Artificial Sequence
  Synthetic oligonucleotide
aauacucauuugaguuccuuccauu

SEQ ID NO: 2551 - RNA, 25 nt, Artificial Sequence
  Synthetic oligonucleotide
cuggugaaauuuaaagugaauucau

SEQ ID NO: 2552 - RNA, 25 nt, Artificial Sequence
  Synthetic oligonucleotide
cauuugaucccuuguuugcuuaaua

SEQ ID NO: 2553 - RNA, 25 nt, Artificial Sequence
  Synthetic oligonucleotide
gaucccuuguuugcuuaauaaauua

SEQ ID NO: 2554 - RNA, 25 nt, Artificial Sequence
  Synthetic oligonucleotide
cuuguuugcuuaauaaauuauaaaa

SEQ ID NO: 2555 - RNA, 25 nt, Artificial Sequence
  Synthetic oligonucleotide
guuugcuuaauaaauuauaaaauga

SEQ ID NO: 2556 - RNA, 25 nt, Artificial Sequence
  Synthetic oligonucleotide
uauaaaaugauggcuuggaaaagca

SEQ ID NO: 2557 - RNA, 25 nt, Artificial Sequence
  Synthetic oligonucleotide
ggucuaagccuaguaugucaauaaa

SEQ ID NO: 2558 - RNA, 25 nt, Artificial Sequence
  Synthetic oligonucleotide
cuaguaugucaauaaagcaaauacu

SEQ ID NO: 2559 - RNA, 25 nt, Artificial Sequence
  Synthetic oligonucleotide
gucaauaaagcaaauacuuacuguu

SEQ ID NO: 2560 - RNA, 25 nt, Artificial Sequence
  Synthetic oligonucleotide
caauaaagcaaauacuuacuguuuu

SEQ ID NO: 2561 - RNA, 25 nt, Artificial Sequence
  Synthetic oligonucleotide
uaaagcaaauacuuacuguuuuguu

SEQ ID NO: 2562 - RNA, 25 nt, Artificial Sequence
  Synthetic oligonucleotide
aagcaaauacuuacuguuuuguuuc

SEQ ID NO: 2563 - RNA, 25 nt, Artificial Sequence
  Synthetic oligonucleotide
aaauacuuacuguuuuguuucuauu

SEQ ID NO: 2564 - RNA, 25 nt, Artificial Sequence
  Synthetic oligonucleotide
uacuuacuguuuuguuucuauuaau

SEQ ID NO: 2565 - RNA, 25 nt, Artificial Sequence
  Synthetic oligonucleotide
cuuacuguuuuguuucuauuaauga

SEQ ID NO: 2566 - RNA, 25 nt, Artificial Sequence
  Synthetic oligonucleotide
uacuguuuuguuucuauuaaugauu

SEQ ID NO: 2567 - RNA, 25 nt, Artificial Sequence
  Synthetic oligonucleotide
guuuuguuucuauuaaugauuccca

SEQ ID NO: 2568 - RNA, 25 nt, Artificial Sequence
  Synthetic oligonucleotide
uuaaugauucccaaaccuuguugca

SEQ ID NO: 2569 - RNA, 25 nt, Artificial Sequence
  Synthetic oligonucleotide
caaaccuuguugcaaguuuuugcau

SEQ ID NO: 2570 - RNA, 25 nt, Artificial Sequence
  Synthetic oligonucleotide
gauuucagucuugauguuuguucua

SEQ ID NO: 2571 - RNA, 25 nt, Artificial Sequence
  Synthetic oligonucleotide
gucuugauguuuguucuaucagacu

SEQ ID NO: 2572 - RNA, 25 nt, Artificial Sequence
  Synthetic oligonucleotide
cugccaucccugaacucuuucuagc

SEQ ID NO: 2573 - RNA, 25 nt, Artificial Sequence
  Synthetic oligonucleotide
cugaacucuuucuagcccuuuuaga

SEQ ID NO: 2574 - RNA, 25 nt, Artificial Sequence
  Synthetic oligonucleotide
gaacucuuucuagcccuuuuagauu

SEQ ID NO: 2575 - RNA, 25 nt, Artificial Sequence
  Synthetic oligonucleotide
gauccuguuagcaggugguaauacc

SEQ ID NO: 2576 - RNA, 25 nt, Artificial Sequence
  Synthetic oligonucleotide
gacugguaucuuuucaacuauuguu

SEQ ID NO: 2577 - RNA, 25 nt, Artificial Sequence
  Synthetic oligonucleotide
aagaacauuuuaugaggcuuucucu

SEQ ID NO: 2578 - RNA, 25 nt, Artificial Sequence
  Synthetic oligonucleotide
gaacauuuuaugaggcuuucucuaa

SEQ ID NO: 2579 - RNA, 25 nt, Artificial Sequence
  Synthetic oligonucleotide
agucuguggacuccauuuaaaaaua

SEQ ID NO: 2580 - RNA, 25 nt, Artificial Sequence
  Synthetic oligonucleotide
cauuagguaugacuguggaaauaca

SEQ ID NO: 2581 - RNA, 25 nt, Artificial Sequence
  Synthetic oligonucleotide
gacaaggaucuuaguugauauuuug

SEQ ID NO: 2582 - RNA, 25 nt, Artificial Sequence
  Synthetic oligonucleotide
gacuacuuuuugacuucuguuuguc

SEQ ID NO: 2583 - RNA, 25 nt, Artificial Sequence
  Synthetic oligonucleotide
cuguuuuuccugagaaaaaaaaaua

SEQ ID NO: 2584 - RNA, 25 nt, Artificial Sequence
  Synthetic oligonucleotide
guuuuuccugagaaaaaaaaauaaa

SEQ ID NO: 2585 - RNA, 25 nt, Artificial Sequence
  Synthetic oligonucleotide
ccugagaaaaaaaaauaaaucuuuu

SEQ ID NO: 2586 - RNA, 25 nt, Artificial Sequence
  Synthetic oligonucleotide
gagaaaaaaaaauaaaucuuuuauu

SEQ ID NO: 2587 - RNA, 25 nt, Artificial Sequence
  Synthetic oligonucleotide
gaaaaaaaaauaaaucuuuuauuca

SEQ ID NO: 2588 - RNA, 25 nt, Artificial Sequence
  Synthetic oligonucleotide
aaaauaaaucuuuuauucaaaaaaa

SEQ ID NO: 2589 - RNA, 25 nt, Artificial Sequence
  Synthetic oligonucleotide
cuggaagagucacugucugaaugaa

SEQ ID NO: 2590 - RNA, 21 nt, Artificial Sequence
  Synthetic oligonucleotide
acgaagacgaugugaaaucgu

SEQ ID NO: 2591 - RNA, 21 nt, Artificial Sequence
  Synthetic oligonucleotide
gcaggauugugacucucauuu

SEQ ID NO: 2592 - RNA, 21 nt, Artificial Sequence
  Synthetic oligonucleotide
aggauugugacucucauuucu

SEQ ID NO: 2593 - RNA, 21 nt, Artificial Sequence
  Synthetic oligonucleotide
uuggugccuuuguggcuaaac

SEQ ID NO: 2594 - RNA, 21 nt, Artificial Sequence
  Synthetic oligonucleotide
gugccuuuguggcuaaacacu

SEQ ID NO: 2595 - RNA, 21 nt, Artificial Sequence
  Synthetic oligonucleotide
uggguuuguggaguucuucca

SEQ ID NO: 2596 - RNA, 21 nt, Artificial Sequence
  Synthetic oligonucleotide
acccuagcaaccuagccagaa

SEQ ID NO: 2597 - RNA, 21 nt, Artificial Sequence
  Synthetic oligonucleotide
uagcaaccuagccagaaaagc

SEQ ID NO: 2598 - RNA, 21 nt, Artificial Sequence
  Synthetic oligonucleotide
agaaaagcaaguggcaagagg

SEQ ID NO: 2599 - RNA, 21 nt, Artificial Sequence
  Synthetic oligonucleotide
gcaagaggauuauggcuaaca

SEQ ID NO: 2600 - RNA, 21 nt, Artificial Sequence
  Synthetic oligonucleotide
gaggauuauggcuaacaagaa

SEQ ID NO: 2601 - RNA, 21 nt, Artificial Sequence
  Synthetic oligonucleotide
ggauuauggcuaacaagaaua

SEQ ID NO: 2602 - RNA, 21 nt, Artificial Sequence
  Synthetic oligonucleotide
auggcuaacaagaauaaauac

SEQ ID NO: 2603 - RNA, 21 nt, Artificial Sequence
  Synthetic oligonucleotide
uugaagagucacugucugaaa

SEQ ID NO: 2604 - RNA, 21 nt, Artificial Sequence
  Synthetic oligonucleotide
agagucacugucugaaagaag

SEQ ID NO: 2605 - RNA, 21 nt, Artificial Sequence
  Synthetic oligonucleotide
gucacugucugaaagaagcaa

SEQ ID NO: 2606 - RNA, 21 nt, Artificial Sequence
  Synthetic oligonucleotide
caguagccaggcaagucauag

SEQ ID NO: 2607 - RNA, 21 nt, Artificial Sequence
  Synthetic oligonucleotide
gccaggcaagucauagaauug

SEQ ID NO: 2608 - RNA, 21 nt, Artificial Sequence
  Synthetic oligonucleotide
uugauuacccgccgaauucau

SEQ ID NO: 2609 - RNA, 21 nt, Artificial Sequence
  Synthetic oligonucleotide
acccgccgaauucauuaauuu

SEQ ID NO: 2610 - RNA, 21 nt, Artificial Sequence
  Synthetic oligonucleotide
ccgaauucauuaauuuacugu

SEQ ID NO: 2611 - RNA, 21 nt, Artificial Sequence
  Synthetic oligonucleotide
guccaaguguucaggacuuuu

SEQ ID NO: 2612 - RNA, 21 nt, Artificial Sequence
  Synthetic oligonucleotide
ccaaguguucaggacuuuuau

SEQ ID NO: 2613 - RNA, 21 nt, Artificial Sequence
  Synthetic oligonucleotide
guucaggacuuuuauaccugu

SEQ ID NO: 2614 - RNA, 21 nt, Artificial Sequence
  Synthetic oligonucleotide
ucaggacuuuuauaccuguua

SEQ ID NO: 2615 - RNA, 21 nt, Artificial Sequence
  Synthetic oligonucleotide
gacuuuuauaccuguuauacu

SEQ ID NO: 2616 - RNA, 21 nt, Artificial Sequence
  Synthetic oligonucleotide
gccuaguuuaucaccaauaau

SEQ ID NO: 2617 - RNA, 21 nt, Artificial Sequence
  Synthetic oligonucleotide
uugacggaaggcucaguaauu

SEQ ID NO: 2618 - RNA, 21 nt, Artificial Sequence
  Synthetic oligonucleotide
gacggaaggcucaguaauuag

SEQ ID NO: 2619 - RNA, 21 nt, Artificial Sequence
  Synthetic oligonucleotide
cggaaggcucaguaauuaguu

SEQ ID NO: 2620 - RNA, 21 nt, Artificial Sequence
  Synthetic oligonucleotide
ggcucaguaauuaguuaugaa

SEQ ID NO: 2621 - RNA, 21 nt, Artificial Sequence
  Synthetic oligonucleotide
cucaguaauuaguuaugaaua

SEQ ID NO: 2622 - RNA, 21 nt, Artificial Sequence
  Synthetic oligonucleotide
aagacagcuuguaaauguauu

SEQ ID NO: 2623 - RNA, 21 nt, Artificial Sequence
  Synthetic oligonucleotide
acagcuuguaaauguauuugu

SEQ ID NO: 2624 - RNA, 21 nt, Artificial Sequence
  Synthetic oligonucleotide
cagaaagucuauuucuuugaa

SEQ ID NO: 2625 - RNA, 21 nt, Artificial Sequence
  Synthetic oligonucleotide
aucgaauuuacauuaguuuuu

SEQ ID NO: 2626 - RNA, 21 nt, Artificial Sequence
  Synthetic oligonucleotide
uacauuaguuuuuuucauacc

SEQ ID NO: 2627 - RNA, 21 nt, Artificial Sequence
  Synthetic oligonucleotide
cauuaguuuuuuucauacccu

SEQ ID NO: 2628 - RNA, 21 nt, Artificial Sequence
  Synthetic oligonucleotide
uucauacccuuuugaacuuug

SEQ ID NO: 2629 - RNA, 21 nt, Artificial Sequence
  Synthetic oligonucleotide
agcuuuucuaugcuaaacuuu

SEQ ID NO: 2630 - RNA, 21 nt, Artificial Sequence
  Synthetic oligonucleotide
ugcuaaacuuuguucuguuca

SEQ ID NO: 2631 - RNA, 21 nt, Artificial Sequence
  Synthetic oligonucleotide
cuaaacuuuguucuguucagu

SEQ ID NO: 2632 - RNA, 21 nt, Artificial Sequence
  Synthetic oligonucleotide
cuguaugcagacugguuguag

SEQ ID NO: 2633 - RNA, 21 nt, Artificial Sequence
  Synthetic oligonucleotide
augcagacugguuguagugga

SEQ ID NO: 2634 - RNA, 21 nt, Artificial Sequence
  Synthetic oligonucleotide
guggaacaaaucugauaacua

SEQ ID NO: 2635 - RNA, 21 nt, Artificial Sequence
  Synthetic oligonucleotide
uugagagguugaugaauggaa

SEQ ID NO: 2636 - RNA, 21 nt, Artificial Sequence
  Synthetic oligonucleotide
gaauggaaauucuuucacuuc

SEQ ID NO: 2637 - RNA, 21 nt, Artificial Sequence
  Synthetic oligonucleotide
uggaaauucuuucacuucauu

SEQ ID NO: 2638 - RNA, 21 nt, Artificial Sequence
  Synthetic oligonucleotide
gaaauucuuucacuucauuau

SEQ ID NO: 2639 - RNA, 21 nt, Artificial Sequence
  Synthetic oligonucleotide
uucacuucauuauaugcaagu

SEQ ID NO: 2640 - RNA, 21 nt, Artificial Sequence
  Synthetic oligonucleotide
cacuucauuauaugcaaguuu

SEQ ID NO: 2641 - RNA, 21 nt, Artificial Sequence
  Synthetic oligonucleotide
uucauuauaugcaaguuuuca

SEQ ID NO: 2642 - RNA, 21 nt, Artificial Sequence
  Synthetic oligonucleotide
cauuauaugcaaguuuucaau

SEQ ID NO: 2643 - RNA, 21 nt, Artificial Sequence
  Synthetic oligonucleotide
auaugcaaguuuucaauaauu

SEQ ID NO: 2644 - RNA, 21 nt, Artificial Sequence
  Synthetic oligonucleotide
aagguuacugaugacuuacaa

SEQ ID NO: 2645 - RNA, 21 nt, Artificial Sequence
  Synthetic oligonucleotide
cucugauugggcaauacucau

SEQ ID NO: 2646 - RNA, 21 nt, Artificial Sequence
  Synthetic oligonucleotide
gcaauacucauuugaguuccu

SEQ ID NO: 2647 - RNA, 21 nt, Artificial Sequence
  Synthetic oligonucleotide
aacuggugaaauuuaaaguga

SEQ ID NO: 2648 - RNA, 21 nt, Artificial Sequence
  Synthetic oligonucleotide
gacauuugaucccuuguuugc

SEQ ID NO: 2649 - RNA, 21 nt, Artificial Sequence
  Synthetic oligonucleotide
uugaucccuuguuugcuuaau

SEQ ID NO: 2650 - RNA, 21 nt, Artificial Sequence
  Synthetic oligonucleotide
cccuuguuugcuuaauaaauu

SEQ ID NO: 2651 - RNA, 21 nt, Artificial Sequence
  Synthetic oligonucleotide
uuguuugcuuaauaaauuaua

SEQ ID NO: 2652 - RNA, 21 nt, Artificial Sequence
  Synthetic oligonucleotide
auuauaaaaugauggcuugga

SEQ ID NO: 2653 - RNA, 21 nt, Artificial Sequence
  Synthetic oligonucleotide
caggucuaagccuaguauguc

SEQ ID NO: 2654 - RNA, 21 nt, Artificial Sequence
  Synthetic oligonucleotide
gccuaguaugucaauaaagca

SEQ ID NO: 2655 - RNA, 21 nt, Artificial Sequence
  Synthetic oligonucleotide
augucaauaaagcaaauacuu

SEQ ID NO: 2656 - RNA, 21 nt, Artificial Sequence
  Synthetic oligonucleotide
gucaauaaagcaaauacuuac

SEQ ID NO: 2657 - RNA, 21 nt, Artificial Sequence
  Synthetic oligonucleotide
aauaaagcaaauacuuacugu

SEQ ID NO: 2658 - RNA, 21 nt, Artificial Sequence
  Synthetic oligonucleotide
uaaagcaaauacuuacuguuu

SEQ ID NO: 2659 - RNA, 21 nt, Artificial Sequence
  Synthetic oligonucleotide
gcaaauacuuacuguuuuguu

SEQ ID NO: 2660 - RNA, 21 nt, Artificial Sequence
  Synthetic oligonucleotide
aauacuuacuguuuuguuucu

SEQ ID NO: 2661 - RNA, 21 nt, Artificial Sequence
  Synthetic oligonucleotide
uacuuacuguuuuguuucuau

SEQ ID NO: 2662 - RNA, 21 nt, Artificial Sequence
  Synthetic oligonucleotide
cuuacuguuuuguuucuauua

SEQ ID NO: 2663 - RNA, 21 nt, Artificial Sequence
  Synthetic oligonucleotide
cuguuuuguuucuauuaauga

SEQ ID NO: 2664 - RNA, 21 nt, Artificial Sequence
  Synthetic oligonucleotide
uauuaaugauucccaaaccuu

SEQ ID NO: 2665 - RNA, 21 nt, Artificial Sequence
  Synthetic oligonucleotide
cccaaaccuuguugcaaguuu

SEQ ID NO: 2666 - RNA, 21 nt, Artificial Sequence
  Synthetic oligonucleotide
uggauuucagucuugauguuu

SEQ ID NO: 2667 - RNA, 21 nt, Artificial Sequence
  Synthetic oligonucleotide
cagucuugauguuuguucuau

SEQ ID NO: 2668 - RNA, 21 nt, Artificial Sequence
  Synthetic oligonucleotide
cccugccaucccugaacucuu

SEQ ID NO: 2669 - RNA, 21 nt, Artificial Sequence
  Synthetic oligonucleotide
cccugaacucuuucuagcccu

SEQ ID NO: 2670 - RNA, 21 nt, Artificial Sequence
  Synthetic oligonucleotide
cugaacucuuucuagcccuuu

SEQ ID NO: 2671 - RNA, 21 nt, Artificial Sequence
  Synthetic oligonucleotide
uugauccuguuagcagguggu

SEQ ID NO: 2672 - RNA, 21 nt, Artificial Sequence
  Synthetic oligonucleotide
uggacugguaucuuuucaacu

SEQ ID NO: 2673 - RNA, 21 nt, Artificial Sequence
  Synthetic oligonucleotide
gaaagaacauuuuaugaggcu

SEQ ID NO: 2674 - RNA, 21 nt, Artificial Sequence
  Synthetic oligonucleotide
aagaacauuuuaugaggcuuu

SEQ ID NO: 2675 - RNA, 21 nt, Artificial Sequence
  Synthetic oligonucleotide
uuagucuguggacuccauuua

SEQ ID NO: 2676 - RNA, 21 nt, Artificial Sequence
  Synthetic oligonucleotide
uucauuagguaugacugugga

SEQ ID NO: 2677 - RNA, 21 nt, Artificial Sequence
  Synthetic oligonucleotide
cagacaaggaucuuaguugau

SEQ ID NO: 2678 - RNA, 21 nt, Artificial Sequence
  Synthetic oligonucleotide
gugacuacuuuuugacuucug

SEQ ID NO: 2679 - RNA, 21 nt, Artificial Sequence
  Synthetic oligonucleotide
uucuguuuuuccugagaaaaa

SEQ ID NO: 2680 - RNA, 21 nt, Artificial Sequence
  Synthetic oligonucleotide
cuguuuuuccugagaaaaaaa

SEQ ID NO: 2681 - RNA, 21 nt, Artificial Sequence
  Synthetic oligonucleotide
uuccugagaaaaaaaaauaaa

SEQ ID NO: 2682 - RNA, 21 nt, Artificial Sequence
  Synthetic oligonucleotide
cugagaaaaaaaaauaaaucu

SEQ ID NO: 2683 - RNA, 21 nt, Artificial Sequence
  Synthetic oligonucleotide
gagaaaaaaaaauaaaucuuu

SEQ ID NO: 2684 - RNA, 21 nt, Artificial Sequence
  Synthetic oligonucleotide
aaaaaauaaaucuuuuauuca

SEQ ID NO: 2685 - RNA, 21 nt, Artificial Sequence
  Synthetic oligonucleotide
cccuggaagagucacugucug

SEQ ID NO: 2686 - RNA, 27 nt, Artificial Sequence
  Synthetic oligonucleotide
acgaagacgaugugaaaucguugucca

SEQ ID NO: 2687 - RNA, 27 nt, Artificial Sequence
  Synthetic oligonucleotide
gcaggauugugacucucauuucuuuca

SEQ ID NO: 2688 - RNA, 27 nt, Artificial Sequence
  Synthetic oligonucleotide
aggauugugacucucauuucuuuugac

SEQ ID NO: 2689 - RNA, 27 nt, Artificial Sequence
  Synthetic oligonucleotide
uuggugccuuuguggcuaaacacuuac

SEQ ID NO: 2690 - RNA, 27 nt, Artificial Sequence
  Synthetic oligonucleotide
gugccuuuguggcuaaacacuugaaac

SEQ ID NO: 2691 - RNA, 27 nt, Artificial Sequence
  Synthetic oligonucleotide
uggguuuguggaguucuuccauguaac

SEQ ID NO: 2692 - RNA, 27 nt, Artificial Sequence
  Synthetic oligonucleotide
acccuagcaaccuagccagaaaagccc

SEQ ID NO: 2693 - RNA, 27 nt, Artificial Sequence
  Synthetic oligonucleotide
uagcaaccuagccagaaaagcaaguaa

SEQ ID NO: 2694 - RNA, 27 nt, Artificial Sequence
  Synthetic oligonucleotide
agaaaagcaaguggcaagaggauuaca

SEQ ID NO: 2695 - RNA, 27 nt, Artificial Sequence
  Synthetic oligonucleotide
gcaagaggauuauggcuaacaagaacc

SEQ ID NO: 2696 - RNA, 27 nt, Artificial Sequence
  Synthetic oligonucleotide
gaggauuauggcuaacaagaauaaacc

SEQ ID NO: 2697 - RNA, 27 nt, Artificial Sequence
  Synthetic oligonucleotide
ggauuauggcuaacaagaauaaauaac

SEQ ID NO: 2698 - RNA, 27 nt, Artificial Sequence
  Synthetic oligonucleotide
auggcuaacaagaauaaauacauggac

SEQ ID NO: 2699 - RNA, 27 nt, Artificial Sequence
  Synthetic oligonucleotide
uugaagagucacugucugaaagaagac

SEQ ID NO: 2700 - RNA, 27 nt, Artificial Sequence
  Synthetic oligonucleotide
agagucacugucugaaagaagcaaaac

SEQ ID NO: 2701 - RNA, 27 nt, Artificial Sequence
  Synthetic oligonucleotide
gucacugucugaaagaagcaaaguuac

SEQ ID NO: 2702 - RNA, 27 nt, Artificial Sequence
  Synthetic oligonucleotide
caguagccaggcaagucauagaauuac

SEQ ID NO: 2703 - RNA, 27 nt, Artificial Sequence
  Synthetic oligonucleotide
gccaggcaagucauagaauugauuaaa

SEQ ID NO: 2704 - RNA, 27 nt, Artificial Sequence
  Synthetic oligonucleotide
uugauuacccgccgaauucauuaaucc

SEQ ID NO: 2705 - RNA, 27 nt, Artificial Sequence
  Synthetic oligonucleotide
acccgccgaauucauuaauuuacugcc

SEQ ID NO: 2706 - RNA, 27 nt, Artificial Sequence
  Synthetic oligonucleotide
ccgaauucauuaauuuacuguagugcc

SEQ ID NO: 2707 - RNA, 27 nt, Artificial Sequence
  Synthetic oligonucleotide
guccaaguguucaggacuuuuauacac

SEQ ID NO: 2708 - RNA, 27 nt, Artificial Sequence
  Synthetic oligonucleotide
ccaaguguucaggacuuuuauaccuac

SEQ ID NO: 2709 - RNA, 27 nt, Artificial Sequence
  Synthetic oligonucleotide
guucaggacuuuuauaccuguuauaac

SEQ ID NO: 2710 - RNA, 27 nt, Artificial Sequence
  Synthetic oligonucleotide
ucaggacuuuuauaccuguuauacucc

SEQ ID NO: 2711 - RNA, 27 nt, Artificial Sequence
  Synthetic oligonucleotide
gacuuuuauaccuguuauacuuuggac

SEQ ID NO: 2712 - RNA, 27 nt, Artificial Sequence
  Synthetic oligonucleotide
gccuaguuuaucaccaauaauacuuac

SEQ ID NO: 2713 - RNA, 27 nt, Artificial Sequence
  Synthetic oligonucleotide
uugacggaaggcucaguaauuaguucc

SEQ ID NO: 2714 - RNA, 27 nt, Artificial Sequence
  Synthetic oligonucleotide
gacggaaggcucaguaauuaguuauac

SEQ ID NO: 2715 - RNA, 27 nt, Artificial Sequence
  Synthetic oligonucleotide
cggaaggcucaguaauuaguuaugacc

SEQ ID NO: 2716 - RNA, 27 nt, Artificial Sequence
  Synthetic oligonucleotide
ggcucaguaauuaguuaugaauaugac

SEQ ID NO: 2717 - RNA, 27 nt, Artificial Sequence
  Synthetic oligonucleotide
cucaguaauuaguuaugaauauggacc

SEQ ID NO: 2718 - RNA, 27 nt, Artificial Sequence
  Synthetic oligonucleotide
aagacagcuuguaaauguauuuguacc

SEQ ID NO: 2719 - RNA, 27 nt, Artificial Sequence
  Synthetic oligonucleotide
acagcuuguaaauguauuuguaaaacc

SEQ ID NO: 2720 - RNA, 27 nt, Artificial Sequence
  Synthetic oligonucleotide
cagaaagucuauuucuuugaaacgaca

SEQ ID NO: 2721 - RNA, 27 nt, Artificial Sequence
  Synthetic oligonucleotide
aucgaauuuacauuaguuuuuuucacc

SEQ ID NO: 2722 - RNA, 27 nt, Artificial Sequence
  Synthetic oligonucleotide
uacauuaguuuuuuucauacccuuuca

SEQ ID NO: 2723 - RNA, 27 nt, Artificial Sequence
  Synthetic oligonucleotide
cauuaguuuuuuucauacccuuuugcc

SEQ ID NO: 2724 - RNA, 27 nt, Artificial Sequence
  Synthetic oligonucleotide
uucauacccuuuugaacuuugcaaccc

SEQ ID NO: 2725 - RNA, 27 nt, Artificial Sequence
  Synthetic oligonucleotide
agcuuuucuaugcuaaacuuuguucca

SEQ ID NO: 2726 - RNA, 27 nt, Artificial Sequence
  Synthetic oligonucleotide
ugcuaaacuuuguucuguucaguuccc

SEQ ID NO: 2727 - RNA, 27 nt, Artificial Sequence
  Synthetic oligonucleotide
cuaaacuuuguucuguucaguucuaac

SEQ ID NO: 2728 - RNA, 27 nt, Artificial Sequence
  Synthetic oligonucleotide
cuguaugcagacugguuguaguggaca

SEQ ID NO: 2729 - RNA, 27 nt, Artificial Sequence
  Synthetic oligonucleotide
augcagacugguuguaguggaacaacc

SEQ ID NO: 2730 - RNA, 27 nt, Artificial Sequence
  Synthetic oligonucleotide
guggaacaaaucugauaacuaugcaaa

SEQ ID NO: 2731 - RNA, 27 nt, Artificial Sequence
  Synthetic oligonucleotide
uugagagguugaugaauggaaauuccc

SEQ ID NO: 2732 - RNA, 27 nt, Artificial Sequence
  Synthetic oligonucleotide
gaauggaaauucuuucacuucauuacc

SEQ ID NO: 2733 - RNA, 27 nt, Artificial Sequence
  Synthetic oligonucleotide
uggaaauucuuucacuucauuauauaa

SEQ ID NO: 2734 - RNA, 27 nt, Artificial Sequence
  Synthetic oligonucleotide
gaaauucuuucacuucauuauaugccc

SEQ ID NO: 2735 - RNA, 27 nt, Artificial Sequence
  Synthetic oligonucleotide
uucacuucauuauaugcaaguuuuccc

SEQ ID NO: 2736 - RNA, 27 nt, Artificial Sequence
  Synthetic oligonucleotide
cacuucauuauaugcaaguuuucaacc

SEQ ID NO: 2737 - RNA, 27 nt, Artificial Sequence
  Synthetic oligonucleotide
uucauuauaugcaaguuuucaauaacc

SEQ ID NO: 2738 - RNA, 27 nt, Artificial Sequence
  Synthetic oligonucleotide
cauuauaugcaaguuuucaauaauuca

SEQ ID NO: 2739 - RNA, 27 nt, Artificial Sequence
  Synthetic oligonucleotide
auaugcaaguuuucaauaauuagguac

SEQ ID NO: 2740 - RNA, 27 nt, Artificial Sequence
  Synthetic oligonucleotide
aagguuacugaugacuuacaaauaaca

SEQ ID NO: 2741 - RNA, 27 nt, Artificial Sequence
  Synthetic oligonucleotide
cucugauugggcaauacucauuugaac

SEQ ID NO: 2742 - RNA, 27 nt, Artificial Sequence
  Synthetic oligonucleotide
gcaauacucauuugaguuccuuccacc

SEQ ID NO: 2743 - RNA, 27 nt, Artificial Sequence
  Synthetic oligonucleotide
aacuggugaaauuuaaagugaauuccc

SEQ ID NO: 2744 - RNA, 27 nt, Artificial Sequence
  Synthetic oligonucleotide
gacauuugaucccuuguuugcuuaacc

SEQ ID NO: 2745 - RNA, 27 nt, Artificial Sequence
  Synthetic oligonucleotide
uugaucccuuguuugcuuaauaaaucc

SEQ ID NO: 2746 - RNA, 27 nt, Artificial Sequence
  Synthetic oligonucleotide
cccuuguuugcuuaauaaauuauaacc

SEQ ID NO: 2747 - RNA, 27 nt, Artificial Sequence
  Synthetic oligonucleotide
uuguuugcuuaauaaauuauaaaauac

SEQ ID NO: 2748 - RNA, 27 nt, Artificial Sequence
  Synthetic oligonucleotide
auuauaaaaugauggcuuggaaaagac

SEQ ID NO: 2749 - RNA, 27 nt, Artificial Sequence
  Synthetic oligonucleotide
caggucuaagccuaguaugucaauacc

SEQ ID NO: 2750 - RNA, 27 nt, Artificial Sequence
  Synthetic oligonucleotide
gccuaguaugucaauaaagcaaauaac

SEQ ID NO: 2751 - RNA, 27 nt, Artificial Sequence
  Synthetic oligonucleotide
augucaauaaagcaaauacuuacugcc

SEQ ID NO: 2752 - RNA, 27 nt, Artificial Sequence
  Synthetic oligonucleotide
gucaauaaagcaaauacuuacuguucc

SEQ ID NO: 2753 - RNA, 27 nt, Artificial Sequence
  Synthetic oligonucleotide
aauaaagcaaauacuuacuguuuugcc

SEQ ID NO: 2754 - RNA, 27 nt, Artificial Sequence
  Synthetic oligonucleotide
uaaagcaaauacuuacuguuuuguuca

SEQ ID NO: 2755 - RNA, 27 nt, Artificial Sequence
  Synthetic oligonucleotide
gcaaauacuuacuguuuuguuucuacc

SEQ ID NO: 2756 - RNA, 27 nt, Artificial Sequence
  Synthetic oligonucleotide
aauacuuacuguuuuguuucuauuacc

SEQ ID NO: 2757 - RNA, 27 nt, Artificial Sequence
  Synthetic oligonucleotide
uacuuacuguuuuguuucuauuaauac

SEQ ID NO: 2758 - RNA, 27 nt, Artificial Sequence
  Synthetic oligonucleotide
cuuacuguuuuguuucuauuaaugacc

SEQ ID NO: 2759 - RNA, 27 nt, Artificial Sequence
  Synthetic oligonucleotide
cuguuuuguuucuauuaaugauuccac

SEQ ID NO: 2760 - RNA, 27 nt, Artificial Sequence
  Synthetic oligonucleotide
uauuaaugauucccaaaccuuguugac

SEQ ID NO: 2761 - RNA, 27 nt, Artificial Sequence
  Synthetic oligonucleotide
cccaaaccuuguugcaaguuuuugccc

SEQ ID NO: 2762 - RNA, 27 nt, Artificial Sequence
  Synthetic oligonucleotide
uggauuucagucuugauguuuguuccc

SEQ ID NO: 2763 - RNA, 27 nt, Artificial Sequence
  Synthetic oligonucleotide
cagucuugauguuuguucuaucagaac

SEQ ID NO: 2764 - RNA, 27 nt, Artificial Sequence
  Synthetic oligonucleotide
cccugccaucccugaacucuuucuaaa

SEQ ID NO: 2765 - RNA, 27 nt, Artificial Sequence
  Synthetic oligonucleotide
cccugaacucuuucuagcccuuuuaac

SEQ ID NO: 2766 - RNA, 27 nt, Artificial Sequence
  Synthetic oligonucleotide
cugaacucuuucuagcccuuuuagacc

SEQ ID NO: 2767 - RNA, 27 nt, Artificial Sequence
  Synthetic oligonucleotide
uugauccuguuagcaggugguaauaaa

SEQ ID NO: 2768 - RNA, 27 nt, Artificial Sequence
  Synthetic oligonucleotide
uggacugguaucuuuucaacuauugcc

SEQ ID NO: 2769 - RNA, 27 nt, Artificial Sequence
  Synthetic oligonucleotide
gaaagaacauuuuaugaggcuuucuac

SEQ ID NO: 2770 - RNA, 27 nt, Artificial Sequence
  Synthetic oligonucleotide
aagaacauuuuaugaggcuuucucucc

SEQ ID NO: 2771 - RNA, 27 nt, Artificial Sequence
  Synthetic oligonucleotide
uuagucuguggacuccauuuaaaaacc

SEQ ID NO: 2772 - RNA, 27 nt, Artificial Sequence
  Synthetic oligonucleotide
uucauuagguaugacuguggaaauaac

SEQ ID NO: 2773 - RNA, 27 nt, Artificial Sequence
  Synthetic oligonucleotide
cagacaaggaucuuaguugauauuuca

SEQ ID NO: 2774 - RNA, 27 nt, Artificial Sequence
  Synthetic oligonucleotide
gugacuacuuuuugacuucuguuugca

SEQ ID NO: 2775 - RNA, 27 nt, Artificial Sequence
  Synthetic oligonucleotide
uucuguuuuuccugagaaaaaaaaacc

SEQ ID NO: 2776 - RNA, 27 nt, Artificial Sequence
  Synthetic oligonucleotide
cuguuuuuccugagaaaaaaaaauacc

SEQ ID NO: 2777 - RNA, 27 nt, Artificial Sequence
  Synthetic oligonucleotide
uuccugagaaaaaaaaauaaaucuucc

SEQ ID NO: 2778 - RNA, 27 nt, Artificial Sequence
  Synthetic oligonucleotide
cugagaaaaaaaaauaaaucuuuuacc

SEQ ID NO: 2779 - RNA, 27 nt, Artificial Sequence
  Synthetic oligonucleotide
gagaaaaaaaaauaaaucuuuuauuac

SEQ ID NO: 2780 - RNA, 27 nt, Artificial Sequence
  Synthetic oligonucleotide
aaaaaauaaaucuuuuauucaaaaacc

SEQ ID NO: 2781 - RNA, 27 nt, Artificial Sequence
  Synthetic oligonucleotide
cccuggaagagucacugucugaaugcc

SEQ ID NO: 2782 - RNA, 27 nt, Artificial Sequence
  Synthetic oligonucleotide
acgaagacgaugugaaaucguugucuc

SEQ ID NO: 2783 - RNA, 27 nt, Artificial Sequence
  Synthetic oligonucleotide
gcaggauugugacucucauuucuuuug

SEQ ID NO: 2784 - RNA, 27 nt, Artificial Sequence
  Synthetic oligonucleotide
aggauugugacucucauuucuuuuggu

SEQ ID NO: 2785 - RNA, 27 nt, Artificial Sequence
  Synthetic oligonucleotide
uuggugccuuuguggcuaaacacuuga

SEQ ID NO: 2786 - RNA, 27 nt, Artificial Sequence
  Synthetic oligonucleotide
gugccuuuguggcuaaacacuugaaga

SEQ ID NO: 2787 - RNA, 27 nt, Artificial Sequence
  Synthetic oligonucleotide
uggguuuguggaguucuuccauguaga

SEQ ID NO: 2788 - RNA, 27 nt, Artificial Sequence
  Synthetic oligonucleotide
acccuagcaaccuagccagaaaagcaa

SEQ ID NO: 2789 - RNA, 27 nt, Artificial Sequence
  Synthetic oligonucleotide
uagcaaccuagccagaaaagcaagugg

SEQ ID NO: 2790 - RNA, 27 nt, Artificial Sequence
  Synthetic oligonucleotide
agaaaagcaaguggcaagaggauuaug

SEQ ID NO: 2791 - RNA, 27 nt, Artificial Sequence
  Synthetic oligonucleotide
gcaagaggauuauggcuaacaagaaua

SEQ ID NO: 2792 - RNA, 27 nt, Artificial Sequence
  Synthetic oligonucleotide
gaggauuauggcuaacaagaauaaaua

SEQ ID NO: 2793 - RNA, 27 nt, Artificial Sequence
  Synthetic oligonucleotide
ggauuauggcuaacaagaauaaauaca

SEQ ID NO: 2794 - RNA, 27 nt, Artificial Sequence
  Synthetic oligonucleotide
auggcuaacaagaauaaauacauggga

SEQ ID NO: 2795 - RNA, 27 nt, Artificial Sequence
  Synthetic oligonucleotide
uugaagagucacugucugaaagaagca

SEQ ID NO: 2796 - RNA, 27 nt, Artificial Sequence
  Synthetic oligonucleotide
agagucacugucugaaagaagcaaagu

SEQ ID NO: 2797 - RNA, 27 nt, Artificial Sequence
  Synthetic oligonucleotide
gucacugucugaaagaagcaaaguuca

SEQ ID NO: 2798 - RNA, 27 nt, Artificial Sequence
  Synthetic oligonucleotide
caguagccaggcaagucauagaauuga

SEQ ID NO: 2799 - RNA, 27 nt, Artificial Sequence
  Synthetic oligonucleotide
gccaggcaagucauagaauugauuacc

SEQ ID NO: 2800 - RNA, 27 nt, Artificial Sequence
  Synthetic oligonucleotide
uugauuacccgccgaauucauuaauuu

SEQ ID NO: 2801 - RNA, 27 nt, Artificial Sequence
  Synthetic oligonucleotide
acccgccgaauucauuaauuuacugua

SEQ ID NO: 2802 - RNA, 27 nt, Artificial Sequence
  Synthetic oligonucleotide
ccgaauucauuaauuuacuguaguguu

SEQ ID NO: 2803 - RNA, 27 nt, Artificial Sequence
  Synthetic oligonucleotide
guccaaguguucaggacuuuuauaccu

SEQ ID NO: 2804 - RNA, 27 nt, Artificial Sequence
  Synthetic oligonucleotide
ccaaguguucaggacuuuuauaccugu

SEQ ID NO: 2805 - RNA, 27 nt, Artificial Sequence
  Synthetic oligonucleotide
guucaggacuuuuauaccuguuauacu

SEQ ID NO: 2806 - RNA, 27 nt, Artificial Sequence
  Synthetic oligonucleotide
ucaggacuuuuauaccuguuauacuuu

SEQ ID NO: 2807 - RNA, 27 nt, Artificial Sequence
  Synthetic oligonucleotide
gacuuuuauaccuguuauacuuuggcu

SEQ ID NO: 2808 - RNA, 27 nt, Artificial Sequence
  Synthetic oligonucleotide
gccuaguuuaucaccaauaauacuuga

SEQ ID NO: 2809 - RNA, 27 nt, Artificial Sequence
  Synthetic oligonucleotide
uugacggaaggcucaguaauuaguuau

SEQ ID NO: 2810 - RNA, 27 nt, Artificial Sequence
  Synthetic oligonucleotide
gacggaaggcucaguaauuaguuauga

SEQ ID NO: 2811 - RNA, 27 nt, Artificial Sequence
  Synthetic oligonucleotide
cggaaggcucaguaauuaguuaugaau

SEQ ID NO: 2812 - RNA, 27 nt, Artificial Sequence
  Synthetic oligonucleotide
ggcucaguaauuaguuaugaauaugga

SEQ ID NO: 2813 - RNA, 27 nt, Artificial Sequence
  Synthetic oligonucleotide
cucaguaauuaguuaugaauauggaua

SEQ ID NO: 2814 - RNA, 27 nt, Artificial Sequence
  Synthetic oligonucleotide
aagacagcuuguaaauguauuuguaaa

SEQ ID NO: 2815 - RNA, 27 nt, Artificial Sequence
  Synthetic oligonucleotide
acagcuuguaaauguauuuguaaaaau

SEQ ID NO: 2816 - RNA, 27 nt, Artificial Sequence
  Synthetic oligonucleotide
cagaaagucuauuucuuugaaacgaag

SEQ ID NO: 2817 - RNA, 27 nt, Artificial Sequence
  Synthetic oligonucleotide
aucgaauuuacauuaguuuuuuucaua

SEQ ID NO: 2818 - RNA, 27 nt, Artificial Sequence
  Synthetic oligonucleotide
uacauuaguuuuuuucauacccuuuug

SEQ ID NO: 2819 - RNA, 27 nt, Artificial Sequence
  Synthetic oligonucleotide
cauuaguuuuuuucauacccuuuugaa

SEQ ID NO: 2820 - RNA, 27 nt, Artificial Sequence
  Synthetic oligonucleotide
uucauacccuuuugaacuuugcaacuu

SEQ ID NO: 2821 - RNA, 27 nt, Artificial Sequence
  Synthetic oligonucleotide
agcuuuucuaugcuaaacuuuguucug

SEQ ID NO: 2822 - RNA, 27 nt, Artificial Sequence
  Synthetic oligonucleotide
ugcuaaacuuuguucuguucaguucua

SEQ ID NO: 2823 - RNA, 27 nt, Artificial Sequence
  Synthetic oligonucleotide
cuaaacuuuguucuguucaguucuaga

SEQ ID NO: 2824 - RNA, 27 nt, Artificial Sequence
  Synthetic oligonucleotide
cuguaugcagacugguuguaguggaac

SEQ ID NO: 2825 - RNA, 27 nt, Artificial Sequence
  Synthetic oligonucleotide
augcagacugguuguaguggaacaaau

SEQ ID NO: 2826 - RNA, 27 nt, Artificial Sequence
  Synthetic oligonucleotide
guggaacaaaucugauaacuaugcagg

SEQ ID NO: 2827 - RNA, 27 nt, Artificial Sequence
  Synthetic oligonucleotide
uugagagguugaugaauggaaauucuu

SEQ ID NO: 2828 - RNA, 27 nt, Artificial Sequence
  Synthetic oligonucleotide
gaauggaaauucuuucacuucauuaua

SEQ ID NO: 2829 - RNA, 27 nt, Artificial Sequence
  Synthetic oligonucleotide
uggaaauucuuucacuucauuauaugc

SEQ ID NO: 2830 - RNA, 27 nt, Artificial Sequence
  Synthetic oligonucleotide
gaaauucuuucacuucauuauaugcaa

SEQ ID NO: 2831 - RNA, 27 nt, Artificial Sequence
  Synthetic oligonucleotide
uucacuucauuauaugcaaguuuucaa

SEQ ID NO: 2832 - RNA, 27 nt, Artificial Sequence
  Synthetic oligonucleotide
cacuucauuauaugcaaguuuucaaua

SEQ ID NO: 2833 - RNA, 27 nt, Artificial Sequence
  Synthetic oligonucleotide
uucauuauaugcaaguuuucaauaauu

SEQ ID NO: 2834 - RNA, 27 nt, Artificial Sequence
  Synthetic oligonucleotide
cauuauaugcaaguuuucaauaauuag

SEQ ID NO: 2835 - RNA, 27 nt, Artificial Sequence
  Synthetic oligonucleotide
auaugcaaguuuucaauaauuaggucu

SEQ ID NO: 2836 - RNA, 27 nt, Artificial Sequence
  Synthetic oligonucleotide
aagguuacugaugacuuacaaauaaug

SEQ ID NO: 2837 - RNA, 27 nt, Artificial Sequence
  Synthetic oligonucleotide
cucugauugggcaauacucauuugagu

SEQ ID NO: 2838 - RNA, 27 nt, Artificial Sequence
  Synthetic oligonucleotide
gcaauacucauuugaguuccuuccauu

SEQ ID NO: 2839 - RNA, 27 nt, Artificial Sequence
  Synthetic oligonucleotide
aacuggugaaauuuaaagugaauucau

SEQ ID NO: 2840 - RNA, 27 nt, Artificial Sequence
  Synthetic oligonucleotide
gacauuugaucccuuguuugcuuaaua

SEQ ID NO: 2841 - RNA, 27 nt, Artificial Sequence
  Synthetic oligonucleotide
uugaucccuuguuugcuuaauaaauua

SEQ ID NO: 2842 - RNA, 27 nt, Artificial Sequence
  Synthetic oligonucleotide
cccuuguuugcuuaauaaauuauaaaa

SEQ ID NO: 2843 - RNA, 27 nt, Artificial Sequence
  Synthetic oligonucleotide
uuguuugcuuaauaaauuauaaaauga

SEQ ID NO: 2844 - RNA, 27 nt, Artificial Sequence
  Synthetic oligonucleotide
auuauaaaaugauggcuuggaaaagca

SEQ ID NO: 2845 - RNA, 27 nt, Artificial Sequence
  Synthetic oligonucleotide
caggucuaagccuaguaugucaauaaa

SEQ ID NO: 2846 - RNA, 27 nt, Artificial Sequence
  Synthetic oligonucleotide
gccuaguaugucaauaaagcaaauacu

SEQ ID NO: 2847 - RNA, 27 nt, Artificial Sequence
  Synthetic oligonucleotide
augucaauaaagcaaauacuuacuguu

SEQ ID NO: 2848 - RNA, 27 nt, Artificial Sequence
  Synthetic oligonucleotide
gucaauaaagcaaauacuuacuguuuu

SEQ ID NO: 2849 - RNA, 27 nt, Artificial Sequence
  Synthetic oligonucleotide
aauaaagcaaauacuuacuguuuuguu

SEQ ID NO: 2850 - RNA, 27 nt, Artificial Sequence
  Synthetic oligonucleotide
uaaagcaaauacuuacuguuuuguuuc

SEQ ID NO: 2851 - RNA, 27 nt, Artificial Sequence
  Synthetic oligonucleotide
gcaaauacuuacuguuuuguuucuauu

SEQ ID NO: 2852 - RNA, 27 nt, Artificial Sequence
  Synthetic oligonucleotide
aauacuuacuguuuuguuucuauuaau

SEQ ID NO: 2853 - RNA, 27 nt, Artificial Sequence
  Synthetic oligonucleotide
uacuuacuguuuuguuucuauuaauga

SEQ ID NO: 2854 - RNA, 27 nt, Artificial Sequence
  Synthetic oligonucleotide
cuuacuguuuuguuucuauuaaugauu

SEQ ID NO: 2855 - RNA, 27 nt, Artificial Sequence
  Synthetic oligonucleotide
cuguuuuguuucuauuaaugauuccca

SEQ ID NO: 2856 - RNA, 27 nt, Artificial Sequence
  Synthetic oligonucleotide
uauuaaugauucccaaaccuuguugca

SEQ ID NO: 2857 - RNA, 27 nt, Artificial Sequence
  Synthetic oligonucleotide
cccaaaccuuguugcaaguuuuugcau

SEQ ID NO: 2858 - RNA, 27 nt, Artificial Sequence
  Synthetic oligonucleotide
uggauuucagucuugauguuuguucua

SEQ ID NO: 2859 - RNA, 27 nt, Artificial Sequence
  Synthetic oligonucleotide
cagucuugauguuuguucuaucagacu

SEQ ID NO: 2860 - RNA, 27 nt, Artificial Sequence
  Synthetic oligonucleotide
cccugccaucccugaacucuuucuagc

SEQ ID NO: 2861 - RNA, 27 nt, Artificial Sequence
  Synthetic oligonucleotide
cccugaacucuuucuagcccuuuuaga

SEQ ID NO: 2862 - RNA, 27 nt, Artificial Sequence
  Synthetic oligonucleotide
cugaacucuuucuagcccuuuuagauu

SEQ ID NO: 2863 - RNA, 27 nt, Artificial Sequence
  Synthetic oligonucleotide
uugauccuguuagcaggugguaauacc

SEQ ID NO: 2864 - RNA, 27 nt, Artificial Sequence
  Synthetic oligonucleotide
uggacugguaucuuuucaacuauuguu

SEQ ID NO: 2865 - RNA, 27 nt, Artificial Sequence
  Synthetic oligonucleotide
gaaagaacauuuuaugaggcuuucucu

SEQ ID NO: 2866 - RNA, 27 nt, Artificial Sequence
  Synthetic oligonucleotide
aagaacauuuuaugaggcuuucucuaa

SEQ ID NO: 2867 - RNA, 27 nt, Artificial Sequence
  Synthetic oligonucleotide
uuagucuguggacuccauuuaaaaaua

SEQ ID NO: 2868 - RNA, 27 nt, Artificial Sequence
  Synthetic oligonucleotide
uucauuagguaugacuguggaaauaca

SEQ ID NO: 2869 - RNA, 27 nt, Artificial Sequence
  Synthetic oligonucleotide
cagacaaggaucuuaguugauauuuug

SEQ ID NO: 2870 - RNA, 27 nt, Artificial Sequence
  Synthetic oligonucleotide
gugacuacuuuuugacuucuguuuguc

SEQ ID NO: 2871 - RNA, 27 nt, Artificial Sequence
  Synthetic oligonucleotide
uucuguuuuuccugagaaaaaaaaaua

SEQ ID NO: 2872 - RNA, 27 nt, Artificial Sequence
  Synthetic oligonucleotide
cuguuuuuccugagaaaaaaaaauaaa

SEQ ID NO: 2873 - RNA, 27 nt, Artificial Sequence
  Synthetic oligonucleotide
uuccugagaaaaaaaaauaaaucuuuu

SEQ ID NO: 2874 - RNA, 27 nt, Artificial Sequence
  Synthetic oligonucleotide
cugagaaaaaaaaauaaaucuuuuauu

SEQ ID NO: 2875 - RNA, 27 nt, Artificial Sequence
  Synthetic oligonucleotide
gagaaaaaaaaauaaaucuuuuauuca

SEQ ID NO: 2876 - RNA, 27 nt, Artificial Sequence
  Synthetic oligonucleotide
aaaaaauaaaucuuuuauucaaaaaaa

SEQ ID NO: 2877 - RNA, 27 nt, Artificial Sequence
  Synthetic oligonucleotide
cccuggaagagucacugucugaaugaa

SEQ ID NO: 2878 - RNA, 21 nt, Artificial Sequence
  Synthetic oligonucleotide
gaaagucuauuucuuugaaac

SEQ ID NO: 2879 - RNA, 21 nt, Artificial Sequence
  Synthetic oligonucleotide
uucaaagaaauagacuuucug

SEQ ID NO: 2880 - RNA, 21 nt, Artificial Sequence
  Synthetic oligonucleotide
cagaaagucuauuucuuugaa

SEQ ID NO: 2881 - RNA, 21 nt, Artificial Sequence
  Synthetic oligonucleotide
cagaaagucuauuucuuugcc

SEQ ID NO: 2882 - DNA, 25 bp, Artificial Sequence
  Synthetic oligonucleotide
gaaagucuauuucuuugaaacaaag

SEQ ID NO: 2883 - DNA, 25 bp, Artificial Sequence
  Synthetic oligonucleotide
gaaagucuauuucuuugaaacgcag

SEQ ID NO: 2884 - DNA, 25 bp, Artificial Sequence
  Synthetic oligonucleotide
gaaagucuauuucuuugaaacgacg

SEQ ID NO: 2885 - DNA, 25 bp, Artificial Sequence
  Synthetic oligonucleotide
gaaagucuauuucuuugaaacgaaa

SEQ ID NO: 2886 - RNA, 27 nt, Artificial Sequence
  Synthetic oligonucleotide
auucguuucaaagaaauagacuuucug

SEQ ID NO: 2887 - RNA, 27 nt, Artificial Sequence
  Synthetic oligonucleotide
ccucguuucaaagaaauagacuuucug

SEQ ID NO: 2888 - RNA, 27 nt, Artificial Sequence
  Synthetic oligonucleotide
cuccguuucaaagaaauagacuuucug

SEQ ID NO: 2889 - RNA, 27 nt, Artificial Sequence
  Synthetic oligonucleotide
cuuaguuucaaagaaauagacuuucug

SEQ ID NO: 2890 - RNA, 25 nt, Artificial Sequence
  Synthetic oligonucleotide
  misc_feature (22)..(25): n is a, c, g, or u
gaaagucuauuucuuugaaacnnnn

SEQ ID NO: 2891 - RNA, 27 nt, Artificial Sequence
  Synthetic oligonucleotide
  misc_feature (1)..(6): n is a, c, g, or u
nnnnnnuucaaagaaauagacuuucug

SEQ ID NO: 2892 - DNA, 27 bp, Artificial Sequence
  Synthetic oligonucleotide
  misc_feature (22)..(27): n is a, c, g, or t
cagaaagtctatttctttgaannnnnn

SEQ ID NO: 2893 - DNA, 29 bp, Artificial Sequence
  Synthetic oligonucleotide
tacagaaagtctatttctttgaaacgaag

SEQ ID NO: 2894 - RNA, 19 nt, Artificial Sequence
  Synthetic oligonucleotide
accggcagucgcuggagau

SEQ ID NO: 2895 - RNA, 19 nt, Artificial Sequence
  Synthetic oligonucleotide
ccggcagucgcuggagauu

SEQ ID NO: 2896 - RNA, 19 nt, Artificial Sequence
  Synthetic oligonucleotide
cggcagucgcuggagauua

SEQ ID NO: 2897 - RNA, 19 nt, Artificial Sequence
  Synthetic oligonucleotide
uccaaggcaugcuucggaa

SEQ ID NO: 2898 - RNA, 19 nt, Artificial Sequence
  Synthetic oligonucleotide
ccaaggcaugcuucggaaa

SEQ ID NO: 2899 - RNA, 19 nt, Artificial Sequence
  Synthetic oligonucleotide
caaggcaugcuucggaaac

SEQ ID NO: 2900 - RNA, 19 nt, Artificial Sequence
  Synthetic oligonucleotide
gggcaggauugugacucuc

SEQ ID NO: 2901 - RNA, 19 nt, Artificial Sequence
  Synthetic oligonucleotide
ggcaggauugugacucuca

SEQ ID NO: 2902 - RNA, 19 nt, Artificial Sequence
  Synthetic oligonucleotide
gcaggauugugacucucau

SEQ ID NO: 2903 - RNA, 19 nt, Artificial Sequence
  Synthetic oligonucleotide
aggcugggauggguuugug

SEQ ID NO: 2904 - RNA, 19 nt, Artificial Sequence
  Synthetic oligonucleotide
ggcugggauggguuugugg

SEQ ID NO: 2905 - RNA, 19 nt, Artificial Sequence
  Synthetic oligonucleotide
gcugggauggguuugugga

SEQ ID NO: 2906 - RNA, 19 nt, Artificial Sequence
  Synthetic oligonucleotide
uggguuuguggaguucuuc

SEQ ID NO: 2907 - RNA, 19 nt, Artificial Sequence
  Synthetic oligonucleotide
ggguuuguggaguucuucc

SEQ ID NO: 2908 - RNA, 19 nt, Artificial Sequence
  Synthetic oligonucleotide
gguuuguggaguucuucca

SEQ ID NO: 2909 - RNA, 19 nt, Artificial Sequence
  Synthetic oligonucleotide
uuggacuccaagcuguaac

SEQ ID NO: 2910 - RNA, 19 nt, Artificial Sequence
  Synthetic oligonucleotide
uggacuccaagcuguaacu

SEQ ID NO: 2911 - RNA, 19 nt, Artificial Sequence
  Synthetic oligonucleotide
ggacuccaagcuguaacuu

SEQ ID NO: 2912 - RNA, 19 nt, Artificial Sequence
  Synthetic oligonucleotide
uagcaaccuagccagaaaa

SEQ ID NO: 2913 - RNA, 19 nt, Artificial Sequence
  Synthetic oligonucleotide
agcaaccuagccagaaaag

SEQ ID NO: 2914 - RNA, 19 nt, Artificial Sequence
  Synthetic oligonucleotide
gcaaccuagccagaaaagc

SEQ ID NO: 2915 - RNA, 19 nt, Artificial Sequence
  Synthetic oligonucleotide
ggaggacuuuuagauuuag

SEQ ID NO: 2916 - RNA, 19 nt, Artificial Sequence
  Synthetic oligonucleotide
gaggacuuuuagauuuagu

SEQ ID NO: 2917 - RNA, 19 nt, Artificial Sequence
  Synthetic oligonucleotide
aggacuuuuagauuuagug

SEQ ID NO: 2918 - RNA, 19 nt, Artificial Sequence
  Synthetic oligonucleotide
caguagccaggcaagucau

SEQ ID NO: 2919 - RNA, 19 nt, Artificial Sequence
  Synthetic oligonucleotide
aguagccaggcaagucaua

SEQ ID NO: 2920 - RNA, 19 nt, Artificial Sequence
  Synthetic oligonucleotide
guagccaggcaagucauag

SEQ ID NO: 2921 - RNA, 19 nt, Artificial Sequence
  Synthetic oligonucleotide
ccaggcaagucauagaauu

SEQ ID NO: 2922 - RNA, 19 nt, Artificial Sequence
  Synthetic oligonucleotide
caggcaagucauagaauug

SEQ ID NO: 2923 - RNA, 19 nt, Artificial Sequence
  Synthetic oligonucleotide
aggcaagucauagaauuga

SEQ ID NO: 2924 - RNA, 19 nt, Artificial Sequence
  Synthetic oligonucleotide
uacccgccgaauucauuaa

SEQ ID NO: 2925 - RNA, 19 nt, Artificial Sequence
  Synthetic oligonucleotide
acccgccgaauucauuaau

SEQ ID NO: 2926 - RNA, 19 nt, Artificial Sequence
  Synthetic oligonucleotide
cccgccgaauucauuaauu

SEQ ID NO: 2927 - RNA, 19 nt, Artificial Sequence
  Synthetic oligonucleotide
gccgaauucauuaauuuac

SEQ ID NO: 2928 - RNA, 19 nt, Artificial Sequence
  Synthetic oligonucleotide
ccgaauucauuaauuuacu

SEQ ID NO: 2929 - RNA, 19 nt, Artificial Sequence
  Synthetic oligonucleotide
cgaauucauuaauuuacug

SEQ ID NO: 2930 - RNA, 19 nt, Artificial Sequence
  Synthetic oligonucleotide
ucaggacuuuuauaccugu

SEQ ID NO: 2931 - RNA, 19 nt, Artificial Sequence
  Synthetic oligonucleotide
caggacuuuuauaccuguu

SEQ ID NO: 2932 - RNA, 19 nt, Artificial Sequence
  Synthetic oligonucleotide
aggacuuuuauaccuguua

SEQ ID NO: 2933 - RNA, 19 nt, Artificial Sequence
  Synthetic oligonucleotide
cucaguaauuaguuaugaa

SEQ ID NO: 2934 - RNA, 19 nt, Artificial Sequence
  Synthetic oligonucleotide
ucaguaauuaguuaugaau

SEQ ID NO: 2935 - RNA, 19 nt, Artificial Sequence
  Synthetic oligonucleotide
caguaauuaguuaugaaua

SEQ ID NO: 2936 - RNA, 19 nt, Artificial Sequence
  Synthetic oligonucleotide
acagcuuguaaauguauuu

SEQ ID NO: 2937 - RNA, 19 nt, Artificial Sequence
  Synthetic oligonucleotide
cagcuuguaaauguauuug

SEQ ID NO: 2938 - RNA, 19 nt, Artificial Sequence
  Synthetic oligonucleotide
agcuuguaaauguauuugu

SEQ ID NO: 2939 - RNA, 19 nt, Artificial Sequence
  Synthetic oligonucleotide
cagaaagucuauuucuuug

SEQ ID NO: 2940 - RNA, 19 nt, Artificial Sequence
  Synthetic oligonucleotide
agaaagucuauuucuuuga

SEQ ID NO: 2941 - RNA, 19 nt, Artificial Sequence
  Synthetic oligonucleotide
gaaagucuauuucuuugaa

SEQ ID NO: 2942 - RNA, 19 nt, Artificial Sequence
  Synthetic oligonucleotide
aucgaauuuacauuaguuu

SEQ ID NO: 2943 - RNA, 19 nt, Artificial Sequence
  Synthetic oligonucleotide
ucgaauuuacauuaguuuu

SEQ ID NO: 2944 - RNA, 19 nt, Artificial Sequence
  Synthetic oligonucleotide
cgaauuuacauuaguuuuu

SEQ ID NO: 2945 - RNA, 19 nt, Artificial Sequence
  Synthetic oligonucleotide
uucauacccuuuugaacuu

SEQ ID NO: 2946 - RNA, 19 nt, Artificial Sequence
  Synthetic oligonucleotide
ucauacccuuuugaacuuu

SEQ ID NO: 2947 - RNA, 19 nt, Artificial Sequence
  Synthetic oligonucleotide
cauacccuuuugaacuuug

SEQ ID NO: 2948 - RNA, 19 nt, Artificial Sequence
  Synthetic oligonucleotide
uggaaauucuuucacuuca

SEQ ID NO: 2949 - RNA, 19 nt, Artificial Sequence
  Synthetic oligonucleotide
ggaaauucuuucacuucau

SEQ ID NO: 2950 - RNA, 19 nt, Artificial Sequence
  Synthetic oligonucleotide
gaaauucuuucacuucauu

SEQ ID NO: 2951 - RNA, 19 nt, Artificial Sequence
  Synthetic oligonucleotide
cacuucauuauaugcaagu

SEQ ID NO: 2952 - RNA, 19 nt, Artificial Sequence
  Synthetic oligonucleotide
acuucauuauaugcaaguu

SEQ ID NO: 2953 - RNA, 19 nt, Artificial Sequence
  Synthetic oligonucleotide
cuucauuauaugcaaguuu

SEQ ID NO: 2954 - RNA, 19 nt, Artificial Sequence
  Synthetic oligonucleotide
aacuggugaaauuuaaagu

SEQ ID NO: 2955 - RNA, 19 nt, Artificial Sequence
  Synthetic oligonucleotide
acuggugaaauuuaaagug

SEQ ID NO: 2956 - RNA, 19 nt, Artificial Sequence
  Synthetic oligonucleotide
cuggugaaauuuaaaguga

SEQ ID NO: 2957 - RNA, 19 nt, Artificial Sequence
  Synthetic oligonucleotide
uuguuugcuuaauaaauua

SEQ ID NO: 2958 - RNA, 19 nt, Artificial Sequence
  Synthetic oligonucleotide
uguuugcuuaauaaauuau

SEQ ID NO: 2959 - RNA, 19 nt, Artificial Sequence
  Synthetic oligonucleotide
guuugcuuaauaaauuaua

SEQ ID NO: 2960 - RNA, 19 nt, Artificial Sequence
  Synthetic oligonucleotide
auuauaaaaugauggcuug

SEQ ID NO: 2961 - RNA, 19 nt, Artificial Sequence
  Synthetic oligonucleotide
uuauaaaaugauggcuugg

SEQ ID NO: 2962 - RNA, 19 nt, Artificial Sequence
  Synthetic oligonucleotide
uauaaaaugauggcuugga

SEQ ID NO: 2963 - RNA, 19 nt, Artificial Sequence
  Synthetic oligonucleotide
aauaaagcaaauacuuacu

SEQ ID NO: 2964 - RNA, 19 nt, Artificial Sequence
  Synthetic oligonucleotide
auaaagcaaauacuuacug

SEQ ID NO: 2965 - RNA, 19 nt, Artificial Sequence
  Synthetic oligonucleotide
uaaagcaaauacuuacugu

SEQ ID NO: 2966 - DNA, 25 bp, Artificial Sequence
  Synthetic oligonucleotide
cgaauuuacauuaguuuuuuuaata

SEQ ID NO: 2967 - DNA, 25 bp, Artificial Sequence
  Synthetic oligonucleotide
cgaauuuacauuaguuuuuuuccta

SEQ ID NO: 2968 - DNA, 25 bp, Artificial Sequence
  Synthetic oligonucleotide
cgaauuuacauuaguuuuuuucaca

SEQ ID NO: 2969 - DNA, 25 bp, Artificial Sequence
  Synthetic oligonucleotide
cgaauuuacauuaguuuuuuucatc

SEQ ID NO: 2970 - RNA, 27 nt, Artificial Sequence
  Synthetic oligonucleotide
caugaaaaaaacuaauguaaauucgau

SEQ ID NO: 2971 - RNA, 27 nt, Artificial Sequence
  Synthetic oligonucleotide
ucugaaaaaaacuaauguaaauucgau

SEQ ID NO: 2972 - RNA, 27 nt, Artificial Sequence
  Synthetic oligonucleotide
uacgaaaaaaacuaauguaaauucgau

SEQ ID NO: 2973 - RNA, 27 nt, Artificial Sequence
  Synthetic oligonucleotide
uauaaaaaaaacuaauguaaauucgau

We claim:

1. An isolated double stranded nucleic acid (dsNA) comprising first and second nucleic acid strands wherein said first nucleic acid strand and said second nucleic acid strand are each 19-50 nucleotides in length, and said second nucleic acid strand is complementary to 5'-CAGAAAGUC-UAUUUCUUUGAAACGAAG-3' (SEQ ID NO: 2014) along at least 19 nucleotides of said second nucleic acid strand length and reduces MCL1 target mRNA expression when said double stranded nucleic acid is introduced into a mammalian cell.

2. An isolated double stranded nucleic acid (dsNA) comprising first and second nucleic acid strands and a duplex region of at least 25 base pairs, wherein said first nucleic acid strand is 15-50 nucleotides in length, said second strand is 25-50 nucleotides in length and comprises the complement of 5'-CAGAAAGUCUAUUUCUUUGAA-3' (SEQ ID NO: 1384) and said dsNA reduces MCL1 target mRNA expression when said double stranded nucleic acid is introduced into a mammalian cell.

3. An isolated double stranded nucleic acid (dsNA) comprising first and second nucleic acid strands and a duplex region of at least 25 base pairs, wherein said first nucleic acid strand and said second nucleic acid strand are each 25-50 nucleotides in length and said second nucleic acid strand comprises at least 21 consecutive nucleotides of 5'-CUUCGUUUCAAAGAAAUAGACUUUCUG-3' (SEQ ID NO: 439) and said dsNA reduces MCL1 target mRNA expression when said dsNA is introduced into a mammalian cell.

4. The isolated dsNA of claim 1 comprising a duplex region selected from the group consisting of at least 25 base pairs; 19-21 base pairs and 21-25 base pairs.

5. The isolated dsNA of claim 1, wherein said second nucleic acid strand comprises 1-5 single-stranded nucleotides at its 3' terminus.

6. The isolated nucleic acid or dsNA of claim 1, wherein said first strand is 25-35 nucleotides in length.

7. The isolated dsNA of claim 1, wherein said second strand is 25-35 nucleotides in length.

8. The isolated dsNA of claim 1, wherein starting from the first nucleotide (position 1) at the 3' terminus of the first nucleic acid strand, position 1, 2 and/or 3 is substituted with a modified nucleotide.

9. The isolated dsNA of claim 1, wherein said 3' terminus of said first strand and said 5' terminus of said second strand form a blunt end.

10. The isolated dsNA of claim 1, wherein said first strand is 25 nucleotides in length and said second strand is 27 nucleotides in length.

11. The isolated dsNA of claim 1, wherein said second strand comprises 5'-CUUCGUUUCAAAGAAAUAGAC-UUUCUG-3' (SEQ ID NO: 439).

12. The isolated dsNA of claim 1, wherein said first strand comprises 5'-GAAAGUCUAUUUCUUUGAAACGAag-3' (SEQ ID NO: 124).

13. The isolated dsNA of claim 1 comprising 5'-GAAA-GUCUAUUUCUUUGAAACGAag-3' (SEQ ID NO: 124) and 5'-CUUCGUUUCAAAGAAAUAGACUUUCUG-3' (SEQ ID NO: 439).

14. The isolated dsNA of claim 1, wherein said dsNA comprises a modified nucleotide.

15. The isolated dsNA of claim 14, wherein said modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O—(N-methylcarbamate).

16. The isolated dsNA of claim 1, wherein said second nucleic acid strand comprises a modification pattern selected from the group consisting of AS-M1 to AS-M48 and AS-M1* to AS-M48*.

17. The isolated dsNA of claim 1, wherein said first nucleic acid strand comprises a modification pattern selected from the group consisting of SM1 to SM24.

18. The isolated dsNA of claim 1, wherein the amount of said isolated nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

19. The isolated dsNA of claim 1, wherein said isolated dsNA is sufficiently complementary to the target MCL1 mRNA sequence to reduce MCL1 target mRNA expression by an amount (expressed by %) selected from the group consisting of at least 10%, at least 50%, at least 80-90%, at least 95%, at least 98%, and at least 99% when said double stranded nucleic acid is introduced into a mammalian cell.

20. The isolated dsNA of claim 1, wherein the first and second strands are joined by a chemical linker.

21. The isolated double stranded nucleic acid of claim 1, wherein said 3' terminus of said first strand and said 5' terminus of said second strand are joined by a chemical linker.

22. The isolated double stranded nucleic acid of claim 1, wherein a nucleotide of said second or first strand is substituted with a modified nucleotide that directs the orientation of Dicer cleavage.

23. The isolated dsNA of claim 1 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

24. The isolated dsNA of claim 1 comprising a phosphate backbone modification selected from the group consisting of a phosphonate, a phosphorothioate and a phosphotriester.

25. The isolated dsNA of claim 1 comprising a modification selected from the group consisting of a morpholino nucleic acid and a peptide nucleic acid (PNA).

26. A method for reducing expression of a target MCL1 gene in a mammalian cell comprising contacting a mammalian cell in vitro with an isolated dsNA of claim 1 in an amount sufficient to reduce expression of a target MCL1 mRNA in said cell.

27. The method of claim 26, wherein target MCL1 mRNA expression is reduced by an amount (expressed by %) selected from the group consisting of at least 10%, at least 50% and at least 80-90%.

28. The method of claim 26, wherein MCL1 mRNA levels are reduced by an amount (expressed by %) of at least 90% at least 8 days after said cell is contacted with said dsNA.

29. The method of claim 26, wherein MCL1 mRNA levels are reduced by an amount (expressed by %) of at least 70% at least 10 days after said cell is contacted with said dsNA.

30. A method for reducing expression of a target MCL1 mRNA in a mammal comprising administering an isolated dsNA of claim 1 to a mammal in an amount sufficient to reduce expression of a target MCL1 mRNA in the mammal.

31. The method of claim 30, wherein said isolated dsNA is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

32. The method of claim 30, wherein MCL1 mRNA levels are reduced in a tissue of said mammal by an amount (expressed by %) of at least 70% at least 3 days after said isolated dsNA is administered to said mammal.

33. The method claim 32, wherein said tissue is liver tissue.

34. The method of claim 30, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

35. A formulation comprising the isolated dsNA of claim 1, wherein said nucleic acid is present in an amount effective to reduce target MCL1 mRNA levels when said nucleic acid is introduced into a mammalian cell in vitro by an amount (expressed by %) selected from the group consisting of at least 10%, at least 50% and at least 80-90%.

36. The formulation of claim 35, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

37. A formulation comprising the isolated dsNA of claim 1, wherein said dsNA is present in an amount effective to reduce target MCL1 mRNA levels when said dsNA is introduced into a cell of a mammalian subject by an amount (expressed by %) selected from the group consisting of at least 10%, at least 50% and at least 80-90%.

38. The formulation of claim 37, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

39. A mammalian cell containing the isolated dsNA of claim 1.

40. A pharmaceutical composition comprising the isolated dsNA of claim 1 and a pharmaceutically acceptable carrier.

41. A kit comprising the isolated dsNA of claim 1 and instructions for its use.

42. A composition possessing MCL1 inhibitory activity consisting essentially of an isolated dsNA of claim 1.

43. The isolated dsNA of claim 1, wherein said first strand comprises a tetraloop.

* * * * *